US007411051B2

(12) United States Patent
Rosen et al.

(10) Patent No.: US 7,411,051 B2
(45) Date of Patent: Aug. 12, 2008

(54) ANTIBODIES TO HDPPA04 POLYPEPTIDE

(75) Inventors: Craig A. Rosen, Laytonsville, MD (US); Steven M. Ruben, Olney, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 177 days.

(21) Appl. No.: 11/001,793

(22) Filed: Dec. 2, 2004

(65) Prior Publication Data
US 2007/0041963 A1 Feb. 22, 2007

Related U.S. Application Data

(60) Division of application No. 10/100,683, filed on Mar. 19, 2002, which is a continuation-in-part of application No. 09/981,876, filed on Oct. 19, 2001, now Pat. No. 7,053,190, which is a division of application No. 09/621,011, filed on Jul. 20, 2000, now Pat. No. 6,878,687, which is a continuation of application No. 09/148,545, filed on Sep. 4, 1998, now Pat. No. 6,590,075, which is a continuation-in-part of application No. PCT/US98/04482, filed on Mar. 6, 1998, said application No. 10/100,683 is a continuation-in-part of application No. 09/621,011, filed on Jul. 20, 2000, now Pat. No. 6,878,687, which is a continuation of application No. 09/148,545, filed on Sep. 4, 1998, now Pat. No. 6,590,075, which is a continuation-in-part of application No. PCT/US98/04482, said application No. 10/100,683 is a continuation-in-part of application No. PCT/US98/04482, said application No. 10/100,683 is a continuation-in-part of application No. 09/882,171, filed on Jun. 18, 2001, now abandoned, which is a continuation of application No. 09/809,391, filed on Mar. 16, 2001, now abandoned, which is a continuation-in-part of application No. PCT/US98/04493, filed on Mar. 6, 1998, said application No. 10/100,683 is a continuation-in-part of application No. 09/809,391, which is a continuation-in-part of application No. 09/149,476, which is a continuation-in-part of application No. PCT/US98/04493, said application No. 10/100,683 is a continuation-in-part of application No. 09/149,476, which is a continuation-in-part of application No. PCT/US98/04493, said application No. 10/100,683 is a continuation-in-part of application No. 10/058,993, filed on Jan. 30, 2002, now Pat. No. 6,951,924, which is a continuation-in-part of application No. 09/852,659, filed on May 11, 2001, now abandoned, which is a continuation-in-part of application No. 09/152,060, filed on Sep. 11, 1998, now Pat. No. 6,448,230, which is a continuation-in-part of application No. PCT/US98/04858, filed on Mar. 12, 1998, said application No. 10/058,993 is a continuation-in-part of application No. 09/853,161, which is a continuation-in-part of application No. 09/152,060, which is a continuation-in-part of application No. PCT/US98/04858, which is a continuation-in-part of application No. 09/852,797, filed on May 11, 2001, now Pat. No. 6,878,806, which is a continuation-in-part of application No. 09/152,060, which is a continuation-in-part of application No. PCT/US98/04858, said application No. 10/100,683 is a continuation-in-part of application No. 09/852,659, which is a continuation-in-part of application No. 09/152,060, which is a continuation-in-part of application No. PCT/US98/04858, said (Continued)

(60) Provisional application No. 60/277,340, filed on Mar. 21, 2001, provisional application No. 60/306,171, filed on Jul. 19, 2001, provisional application No. 60/331,287, filed on Nov. 13, 2001, provisional application No. 60/040,162, filed on Mar. 7, 1997, provisional application No. 60/038,621, filed on Mar. 7, 1997, provisional application No. 60/040,161, filed on Mar. 7, 1997, provisional application No. 60/040,626, filed on Mar. 7, 1997, provisional application No. 60/040,334, filed on Mar. 7, 1997, provisional application No. 60/040,336, filed on Mar. 7, 1997, provisional application No. 60/040,163, filed on Mar. 7, 1997, provisional application No. 60/047,615, filed on May 23, 1997, provisional application No. 60/047,600, filed on May 23, 1997, provisional application No. 60/047,597, filed on May 23, 1997, provisional application No. 60/047,502, filed on May 23, 1997, provisional application No. 60/047,633, filed on May 23, 1997, provisional application No. 60/047,583, filed on May 23, 1997, provisional application No. 60/047,617, filed on May 23, 1997, provisional application No. 60/047,618, filed on May 23, 1997, provisional application No. 60/047,503, filed on May 23, 1997, provisional application No. 60/047,592, filed on (Continued)

(51) Int. Cl.
C07K 16/00 (2006.01)
(52) U.S. Cl. .............. 530/388.7; 530/387.9; 530/387.1; 530/387.3
(58) Field of Classification Search ....................... None
See application file for complete search history.

(56) References Cited

U.S. PATENT DOCUMENTS

2002/0095024 A1* 7/2002 Mikesell et al. ............. 530/350

* cited by examiner

Primary Examiner—G. R. Ewoldt
Assistant Examiner—Amy Juedes
(74) Attorney, Agent, or Firm—Foley & Lardner LLP

(57) ABSTRACT

The present invention relates to antibodies that specifically bind HDPPA04 polypeptides, useful for diagnosing and treating diseases, disorders, and/or conditions related to said HDPPA04. Also encompassed by the invention are host cells and hybridomas for producing said antibodies. The invention further encompasses methods for detecting said HDPPA04 polypeptides using said antibodies.

31 Claims, No Drawings

Related U.S. Application Data

(60) application No. 10/100,683 is a continuation-in-part of application No. 09/853,161, which is a continuation-in-part of application No. 09/152,060, which is a continuation-in-part of application No. PCT/US98/04858, said application No. 10/100,683 is a continuation-in-part of application No. 09/852,797, filed on May 11, 2001, now abandoned, which is a continuation-in-part of application No. 09/152,060, which is a continuation-in-part of application No. PCT/US98/04858, said application No. 10/100,683 is a continuation-in-part of application No. 10/059,395, filed on Jan. 31, 2002, now abandoned, which is a division of application No. 09/966,262, filed on Oct. 1, 2001, now abandoned, which is a continuation of application No. 09/154,707, filed on Sep. 17, 1998, now abandoned, which is a continuation-in-part of application No. PCT/US98/05311, filed on Mar. 19, 1998, now abandoned, said application No. 10/100,683 is a continuation-in-part of application No. 09/984,245, filed on Oct. 29, 2001, now abandoned, which is a division of application No. 09/154,707, which is a continuation-in-part of application No. PCT/US98/05311, said application No. 10/100,683 is a continuation-in-part of application No. 09/983,966, filed on Oct. 26, 2001, now abandoned, which is a division of application No. 09/154,707, which is a continuation-in-part of application No. PCT/US98/05311, said application No. 10/100,683 is a continuation-in-part of application No. 09/966,262, which is a continuation of application No. 09/154,707, said application No. 10/100,683 is a continuation-in-part of application No. 09/814,122, filed on Mar. 22, 2001, now abandoned, which is a continuation of application No. 09/577,145, filed on May 24, 2000, now abandoned, which is a continuation of application No. 09/166,780, filed on Oct. 6, 1998, now abandoned, which is a continuation-in-part of application No. PCT/US98/06801, filed on Apr. 7, 1998, said application No. 10/100,683 is a continuation-in-part of application No. PCT/US98/06801, said application No. 10/100,683 is a continuation-in-part of application No. PCT/US98/11422, filed on Jun. 4, 1998, said application No. 10/100,683 is a continuation-in-part of application No. PCT/US01/05614, filed on Feb. 21, 2001, said application No. 10/100,683 is a continuation-in-part of application No. PCT/US98/12125, filed on Jun. 11, 1998, said application No. 10/100,683 is a continuation-in-part of application No. 09/627,081, filed on Jul. 27, 2000, which is a continuation of application No. 09/213,365, filed on Dec. 17, 1998, which is a continuation-in-part of application No. PCT/US98/13608, filed on Jun. 30, 1998, said application No. 10/100,683 is a continuation-in-part of application No. PCT/US98/13608, filed on Jul. 7, 1998, said application No. 10/100,683 is a continuation-in-part of application No. 09/983,802, filed on Oct. 25, 2001, which is a continuation of application No. 09/277,357, which is a continuation-in-part of application No. PCT/US98/13684, said application No. 10/100,683 is a continuation-in-part of application No. 09/973,278, filed on Oct. 10, 2001, which is a continuation-in-part of application No. 09/227,357, which is a continuation-in-part of application No. PCT/US98/13684, said application No. 10/100,683 is a continuation-in-part of application No. 09/776,724, filed on Feb. 6, 2001, which is a continuation-in-part of application No. 09/669,688, filed on Sep. 26, 2000, which is a continuation of application No. 09/229,982, filed on Jan. 14, 1999, which is a continuation-in-part of application No. PCT/US98/14613, filed on Jul. 15, 1998, said application No. 10/100,683 is a continuation-in-part of application No. 09/820,649, filed on Mar. 30, 2001, which is a continuation of application No. 09/666,984, filed on Sep. 21, 2000, which is a continuation of application No. 09/236,557, filed on Jan. 26, 1999, which is a continuation-in-part of application No. PCT/US98/15949, filed on Jul. 29, 1998, said application No. 10/100,683 is a continuation-in-part of application No. PCT/US98/15949, said application No. 10/100,683 is a continuation-in-part of application No. 09/969,730, filed on Oct. 4, 2001, which is a continuation-in-part of application No. 09/774,639, filed on Feb. 1, 2001, which is a continuation of application No. 09/244,112, filed on Feb. 4, 1999, which is a continuation-in-part of application No. PCT/US98/16235, filed on Aug. 4, 1998, said application No. 10/100,683 is a continuation-in-part of application No. 09/774,639, which is a continuation of application No. 09/244,112, which is a continuation-in-part of application No. PCT/US98/16235, said application No. 10/100,683 is a continuation-in-part of application No. 09/969,730, said application No. 10/100,683 is a continuation-in-part of application No. PCT/US98/16235, said application No. 10/100,683 is a continuation-in-part of application No. 09/716,128, filed on Nov. 17, 2000, which is a continuation of application No. 09/251,329, filed on Feb. 17, 1999, which is a continuation-in-part of application No. PCT/US98/17044, filed on Aug. 18, 1998, said application No. 10/100,683 is a continuation-in-part of application No. PCT/US98/17044, said application No. 10/100,683 is a continuation-in-part of application No. 09/722,329, filed on Nov. 28, 2000, which is a continuation of application No. 09/262,109, filed on Mar. 4, 1999, which is a continuation-in-part of application No. PCT/US98/18360, filed on Sep. 3, 1998, said application No. 10/100,683 is a continuation-in-part of application No. 09/722,329, which is a continuation of application No. 09/262,109, which is a continuation-in-part of application No. PCT/US98/18360, said application No. 10/100,683 is a continuation-in-part of application No. PCT/US02/01109, filed on Jan. 17, 2002, said application No. 10/100,683 is a continuation-in-part of application No. PCT/US98/18360, said application No. 10/100,683 is a continuation-in-part of application No. 09/281,976, filed on Mar. 31, 1999, which is a continuation-in-part of application No. PCT/US98/20775, filed on Oct. 1, 1998, said application No. 10/100,683 is a continuation-in-part of application No. PCT/US98/20775, said application No. 10/100,683 is a continuation-in-part of application No. 09/984,429, filed on Oct. 30, 2001, which is a continuation-in-part of application No. 09/288,143, filed on Apr. 8, 1999, which is a continuation-in-part of application No. PCT/US98/21142, filed on Oct. 8, 1998, said application No. 10/100,683 is a continuation-in-part of application No. 09/288,143, which is a continuation-in-part of application No. PCT/US98/21142, said application No. 10/100,683 is a continuation-in-part of application No. 09/296,622, filed on Apr. 23, 1999, which is a continuation-in-part of application No. PCT/US98/22376, filed on Oct. 23, 1998, said application No. 10/100,683 is a continuation-in-part of application No. PCT/US98/22376, said application No. 10/100,683 is a continuation-in-part of application No. 09/974,879, filed on Oct. 12, 2001, which is a continuation-in-part of application No. 09/818,683, filed on Mar. 28, 2001, which is a continuation of application No. 09/305,736, filed on May 5, 1999, which is a continuation-in-part of application No. PCT/US98/23435, filed on Nov. 4, 1998, said application No. 10/100,683 is a continuation-in-part of application No. 09/818,683, which is a continuation of application No. 09/305,736, which is a continuation-in-part of application No. PCT/US98/23435, said application No. 10/100,683 is a continuation-in-part of application No. 09/334,595, filed on Jun. 17, 1999, which is a continuation-in-part of application No. PCT/US98/27059, filed on Dec. 17, 1998, said application No. 10/100,683 is a continuation-in-part of application No. PCT/US98/27059, said application No. 10/100,683 is a continuation-in-part of application No. 09/938,671, filed on Aug. 27, 2001, which is a continuation of application No. 09/739,907, filed on Dec. 20, 2000, and a division of application No. 09/348,457, filed on Jul. 7, 1999, which is a continuation-in-part of application No. PCT/US99/00108, filed on Jan. 6, 1999, said application No. 10/100,683 is a continuation-in-part of application No. 09/739,907, which is a continuation of application No. 09/348,457, which is a continuation-in-part of application No. PCT/US99/00108, said application No. 10/100,683 is a continuation-in-part of application No. 09/348,457, which is a continuation-in-part of application No. PCT/US99/00108, application No. 10/100,683, which is a continuation-in-part of application No. PCT/US99/00108, said application No. 10/100,683 is a continuation-in-part of application No. 09/949,925, filed on Sep. 21, 2001, which is a continuation-in-part of application No. PCT/US99/01621, filed on Jan. 27, 1999, which is a continuation-in-part of application No. 09/363,044, filed on Jul. 29, 1999, which is a continuation-in-part of application No. PCT/US99/01621, said application No. 10/100,638 is a continuation-in-part of application No. 09/813,153, filed on Mar. 21, 2001, which is a continuation of application No. 09/363,044, which is a continuation-in-part of application No. PCT/US99/01621, said application No. 10/100,683 is a continuation-in-part of application No. 09/363,044, which is a continuation-in-part of application No. PCT/US99/01621, said application No. 10/100,683 is a continuation-in-part of application No. PCT/US99/01621, said application No. 10/100,683 is a continuation-in-part of application No. 10/062,548, filed on Feb. 5, 2002, which is a continuation of application No. 09/369,247, filed on Aug. 5, 1999, which is a continuation-in-part of application No. PCT/US99/02293, filed on Feb. 4, 1999, said application No. 10/100,683 is a continuation-in-part of application No. 09/369,247, which is a continuation of application No. PCT/US99/02293, said application No. 10/100,683 is a continuation-in-part of application No. PCT/US99/02293, said application No. 10/100,683 is a continuation-in-part of application No. 09/716,129, filed on Nov. 17, 2000, which is a continuation-in-part of application No. PCT/US99/03939, filed on Feb. 24, 1999, which is a continuation of application No. 09/382,572, filed on Aug. 25, 1999, which is a continuation-in-part of application No. PCT/US99/03939, said application No. 10/100,683 is a continuation-in-part of application No. PCT/US99/03939, said application No. 10/100,683 is a continuation-in-part of application No. 09/798,889, filed on Mar. 6, 2001, which is a continuation of application No. 09/393,022, filed on Sep. 9, 1999, which is a continuation-in-part of application No. PCT/US99/05721, filed on Mar. 11, 1999, said application No. 10/100,683 is a continuation-in-part of application No. PCT/US99/05721, said application No. 10/100,683 is a continuation-in-part of application No. 09/397,945, filed on Sep. 17, 1999, which is a continuation-in-part of application No. PCT/US99/05804, filed on Mar. 18, 1999, said application No. 10/100,683 is a continuation-in-part of application No. PCT/US99/05804, said application No. 10/100,683 is a continuation-in-part of application No. 09/948,783, filed on Sep. 10, 2001, which is a continuation-in-part of application No. 09/892,877, filed on Jun. 28, 2001, which is a continuation of application No. 09/437,658, filed on Nov. 10, 1999, which is a continuation-in-part of application No. PCT/US99/09847, filed on May 6, 1999, said application No. 10/100,683 is a continuation-in-part of application No. 09/892,877, and a division of application No. 09/437,658, which is a continuation-in-part of application No. PCT/US99/09847, said application No. 10/100,683 is a continuation-in-part of application No. PCT/US99/09847, said application No. 10/100,683 is a continuation-in-part of application No. 10/050,873, filed on Jan. 18, 2002, which is a continuation-in-part of application No. 09/461,325, filed on Dec. 14, 1999, which is a continuation-in-part of application No. PCT/US99/13418, filed on Jun. 15, 1999, said application No. 10/100,683 is a continuation-in-part of application No. 10/012,542, filed on Dec. 12, 2001, which is a division of application No. 09/461,325, which is a continuation-in-part of application No. PCT/US99/13418, said application No. 10/100,683 is a continuation-in-part of application No. 09/461,325, which is a continuation-in-part of application No. PCT/US99/13418, said application No. 10/100,683 is a continuation-in-part of application No. PCT/US99/13418, said application No. 10/100,683 is a continuation-in-part of application No. 09/984,271, filed on Oct. 29, 2001, which is a division of application No. 09/482,273, filed on Jan. 13, 2000, which is a continuation-in-part of application No. PCT/US99/15849, filed on Jul. 14, 1999, said application No. 10/100,683 is a continuation-in-part of application No. 09/984,276, filed on Oct. 29, 2001, which is a division of application No. 09/482,273, which is a continuation-in-part of application No. PCT/US99/15849, said application No. 10/100,683 is a continuation-in-part of application No. 09/482,273, which is a continuation-in-part of application No. PCT/US99/15849, said application No. 10/100,683 is a continuation-in-part of application No. PCT/US99/15849, said application No. 10/100,683 is a continuation-in-part of application No. PCT/US01/29871, filed on Sep. 24, 2001, said application No. 10/100,683 is a continuation-in-part of application No. PCT/US01/00911, filed on Jan. 12, 2001, which is a continuation-in-part of application No. 09/482,273, said application No. 10/100,683 is a continuation-in-part of application No. 09/489,847, filed on Jan. 24, 2000, which is a continuation-in-part of application No. PCT/US99/17130, filed on Jul. 29, 1999, said application No. 10/100,683 is a continuation-in-part of application No. PCT/US99/17130, said application No. 10/100,683 is a continuation-in-part of application No. 10/054,988, filed on Jan. 25, 2002, which is a continuation of application No. 09/904,615, filed on Jul. 16, 2001, which is a continuation of application No. 09/739,254, filed on Dec. 19, 2000, which is a continuation of application No. 09/511,554, filed on Feb. 23, 2000, which is a continuation-in-part of application No. PCT/US99/19330, filed on Aug. 24, 1999, said application No. 10/100,683 is a continuation-in-part of application No. 09/904,615, which is a continuation of application No. 09/739,254, which is a continuation of application No. 09/511,554, which is a continuation-in-part of application No. PCT/US99/19330, said application No. 10/100,683 is a continuation-in-part of application No. PCT/US99/19330, said application No. 10/100,683 is a continuation-in-part of application No. 09/820,893, filed on Mar. 30, 2001, which is a continuation of application No. 09/531,119, filed on Mar. 20, 2000, which is a continuation-in-part of application No. PCT/US99/22012, filed on Sep. 22, 1999, which is a continuation-in-part of application No. PCT/US99/22012, said application No. 10/100,683 is a continuation-in-part of application No. 09/948,820, filed on Sep. 10, 2001, which is a continuation of application No. 09/565,391, filed on May 5, 2000, which is a continuation-in-part of application No. PCT/US99/26409, filed on Nov. 9, 1999, said application No. 10/100,683 is a continuation-in-part of application No. 09/565,391, which is a continuation-in-part of application No. PCT/US99/26409, said application No. 10/100,683 is a continuation-in-part of application No. PCT/US99/26409, said application No. 10/100,683 is a continuation-in-part of application No. 09/895,298, filed on Jul. 2, 2001, which is a continuation of application No. 09/591,316, filed on Jun. 9, 2000, which is a continuation-in-part of application No. PCT/US99/29950, filed on Dec. 16, 1999, said application No. 10/100,683 is a continuation-in-part of application No. PCT/US99/29950, said application No. 10/100,683 is a continuation-in-part of application No. 09/985,153, filed on Nov. 1, 2001, which is a continuation of application No. 09/618,150, filed on Jul. 17, 2000, which is a continuation-in-part of application No. PCT/US00/00903, filed on Jan. 18, 2000, said application No. 10/100,683 is a continuation-in-part of application No. PCT/US00/00903, said application No. 10/100,683 is a continuation-in-part of application No. 09/997,131, filed on Nov. 20, 2001, which is a continuation of application No. 09/628,508, filed on Jul. 28, 2000, which is a continuation-in-part of application No. PCT/US00/03062, filed on Feb. 8, 2000, which is a division of application No. 10/100,683, which is a continuation-in-part of application No. PCT/US00/03062, said application No. 10/100,683 is a continuation-in-part of application No. 10/050,882, filed on Jan. 18, 2002, which is a continuation of application No. 09/661,453, filed on Sep. 13, 2000, which is a continuation-in-part of application No. PCT/US00/06783, filed on Mar. 16, 2000, said application No. 10/100,683 is a continuation-in-part of application No. 09/661,453, filed on Sep. 13, 2000, which is a continuation-in-part of application No. PCT/US00/06783, filed on Mar. 16, 2000, said application No. 10/100,683 is a continuation-in-part of application No. PCT/US00/06783, said application No. 10/100,683 is a continuation of application No. 10/050,704, filed on Jan. 18, 2002, which is a continuation of application No. 09/684,524, filed on Oct. 10, 2000, which is a continuation-in-part of application No. PCT/US00/08979, filed on Apr. 6, 2000, said application No. 10/100,683 is a continuation-in-part of application No. 09/684,524, which is a continuation-in-part of application No. PCT/US00/08979, said application No. 10/100,683 is a continuation-in-part of application No. PCT/US00/08979, said application No. 10/100,683 is a continuation-in-part of application No. 10/042,141, filed on Jan. 11, 2002, which is a continuation of application No. 09/726,643, filed on Dec. 1, 2000, which is a continuation-in-part of application No. PCT/US00/15187, filed on Jun. 2, 2000, said application No. 10/100,683 is a continuation-in-part of application No. 09/726,643, which is a continuation-in-part of application No. PCT/US00/15187, said application No. 10/100,683 is a continuation-in-part of application No. PCT/US00/15187, said application No. 10/100,683 is a continuation-in-part of application No. 09/756,168, filed on Jan. 9, 2001, which is a continuation-in-part of application No. PCT/US00/19735, filed on Jul. 23, 1999, said application No. 10/100,683 is a continuation-in-part of application No. PCT/US00/19735, said application No. 10/100,683 is a continuation-in-part of application No. 10/060,255, filed on Feb. 1, 2002, which is a continuation of application No. 09/781,417, filed on Feb. 13, 2001, which is a continuation-in-part of application No. PCT/US00/22325, filed on Aug. 16, 2000, said application No. 10/100,683 is a continuation-in-part of application No. PCT/US00/22325, said application No. 10/100,683 is a continuation-in-part of application No. 09/789,561, filed on Feb. 22, 2001, which is a continuation-in-part of application No. PCT/US00/24008, filed on Aug. 31, 2000, said application No. 10/100,683 is a continuation-in-part of application No. PCT/US00/24008, said application No. 10/100,683 is a continuation-in-part of application No. 09/800,729, filed on Mar. 8, 2001, which is a continuation-in-part of application No. PCT/US00/26013, filed on Sep. 22, 2000, said application No. 10/100,683 is a continuation-in-part of application No. PCT/US00/26013, said application No. 10/100,683 is a continuation-in-part of application No. 09/832,129, filed on Apr. 11, 2001, which is a continuation-in-part of application No. PCT/US00/28664, filed on Oct. 17, 2000, said application No. 10/100,683 is a continuation-in-part of application No. PCT/US00/28664, said application No. 10/100,683 is a continuation-in-part of application No. PCT/US00/29363, filed on Oct. 25, 2000, said application No. 10/100,683 is a continuation-in-part of application No. PCT/US00/29360, filed on Oct. 25, 2000, said application No. 10/100,683 is a continuation-in-part of application No. PCT/US00/29362, filed on Oct. 25, 2000, said application No. 10/100,683 is a continuation-in-part of application No. PCT/US00/29365, filed on Oct. 25, 2000, said application No. 10/100,683 is a continuation-in-part of application No. PCT/US00/29364, filed on Oct. 25, 2000, said application No. 10/100,683 is a continuation-in-part of application No. PCT/US00/30040, filed on Nov. 1, 2000, said application No. 10/100,683 is a continuation-in-part of application No. PCT/US00/30037, filed on Nov. 1, 2000, which is a division of application No. 10/100,683, which is a continuation-in-part of application No. PCT/US00/30045, filed on Nov. 1, 2000, said application No. 10/100,683 is a continuation-in-part of application No. PCT/US00/30036, filed on Nov. 1, 2000, said application No. 10/100,683 is a continuation-in-part of application No. PCT/US00/30039, filed on Nov. 1, 2000, said application No. 10/100,683 is a continuation-in-part of application No. PCT/US00/30654, filed on Nov. 8, 2000, said application No. 10/100,683 is a continuation-in-part of application No. PCT/US00/30628, filed on Nov. 8, 2000, said application No. 10/100,683 is a continuation-in-part of application No. PCT/US00/30653, filed on Nov. 8, 2000, said application No. 10/100,683 is a continuation-in-part of application No. PCT/US00/30629, filed on Nov. 8, 2000, said application No. 10/100,683 is a continuation-in-part of application No. PCT/US00/30679, filed on Nov. 8, 2000, said application No. 10/100,683 is a continuation-in-part of application No. PCT/US00/30674, filed on Nov. 8, 2000, said application No. 10/100,683 is a continuation-in-part of application No. PCT/US00/31162, filed on Nov. 15, 2000, said application No. 10/100,683 is a continuation-in-part of application No. PCT/US00/31282, filed on Nov. 15, 2000, said application No. 10/100,683 is a continuation-in-part of application No. PCT/US00/30657, filed on Nov. 8, 2000, said application No. 10/100,683 is a continuation-in-part of application No. PCT/US01/01396, filed on Jan. 17, 2001, said application No. 10/100,683 is a continuation-in-part of application No. PCT/US01/01387, filed on Jan. 17, 2001, said application No. 10/100,683 is a continuation-in-part of application No. PCT/US01/01567, filed on Jan. 17, 2001, said application No. 10/100,683 is a continuation-in-part of application No. PCT/US01/01431, filed on Jan. 17, 2001, said application No. 10/100,683 is a continuation-in-part of application No. PCT/US01/01432, filed on Jan. 17, 2001, said application No. 10/100,683 is a continuation-in-part of application No. PCT/US01/00544, filed on Jan. 9, 2001, said application No. 10/100,683 is a continuation-in-part of application No. PCT/US01/01435, filed on Jan. 17, 2001, said application No. 10/100,683 is a continuation-in-part of application No. PCT/US01/01386, filed on Jan. 17, 2001, said application No. 10/100,683 is a continuation-in-part of application No. PCT/US01/01565, filed on Jan. 17, 2001, said application No. 10/100,683 is a continuation-in-part of application No. PCT/US01/01394, filed on Jan. 17, 2001, said application No. 10/100,683 is a continuation-in-part of application No. PCT/US01/01434, filed on Jan. 17, 2001, said application No. 10/100,683 is a continuation-in-part of application No. PCT/US01/01397, filed on Jan. 17, 2001, said application No. 10/100,683 is a continuation-in-part of application No. PCT/US01/01385, filed on Jan. 17, 2001, said application No. 10/100,683 is a continuation-in-part of application No. PCT/US01/01384, filed on Jan. 17, 2001, said application No. 10/100,683 is a continuation-in-part of application No. PCT/US01/01383, filed on Jan. 17, 2001, which is a division of application No. 10/100,683, which is a continuation-in-part of application No. PCT/US02/05064, filed on Feb. 21, 2002, said application No. 10/100,683 is a continuation-in-part of application No. PCT/US02/05301, filed on Feb. 21, 2002.

(60) May 23, 1997, provisional application No. 60/047,581, filed on May 23, 1997, provisional application No. 60/047,584, filed on May 23, 1997, provisional application No. 60/047,500, filed on May 23, 1997, provisional application No. 60/047,587, filed on May 23, 1997, provisional application No. 60/047,492, filed on May 23, 1997, provisional application No. 60/047,598, filed on May 23, 1997, provisional application No. 60/047,613, filed on May 23, 1997, provisional application No. 60/047,582, filed on May 23, 1997, provisional application No. 60/047,596, filed on May 23, 1997, provisional application No. 60/047,612, filed on May 23, 1997, provisional application No. 60/047,632, filed on May 23, 1997, provisional application No. 60/047,601, filed on May 23, 1997, provisional application No. 60/043,580, filed on Apr. 11, 1997, provisional application No. 60/043,568, filed on Apr. 11, 1997, provisional application No. 60/043,314, filed on Apr. 11, 1997, provisional application No. 60/043,569, filed on Apr. 11, 1997, provisional application No. 60/043,311, filed on Apr. 11, 1997, provisional application No. 60/043,671, filed on Apr. 11, 1997, provisional application No. 60/043,674, filed on Apr. 11, 1997, provisional application No. 60/043,669, filed on Apr. 11, 1997, provisional application No. 60/043,312, filed on Apr. 11, 1997, provisional application No. 60/043,313, filed on Apr. 11, 1997, provisional application No. 60/043,672, filed on Apr. 11, 1997, provisional application No. 60/043,315, filed on Apr. 11, 1997, provisional application No. 60/048,974, filed on Jun. 6, 1997, provisional application No. 60/056,886, filed on Aug. 22, 1997, provisional application No. 60/056,889, filed on Aug. 22, 1997, provisional application No. 60/056,893, filed on Aug. 22, 1997, provisional application No. 60/056,630, filed on Aug. 22, 1997, provisional application No. 60/056,878, filed on Aug. 22, 1997, provisional application No. 60/056,662, filed on Aug. 22, 1997, provisional application No. 60/056,872, filed on Aug. 22, 1997, provisional application No. 60/056,882, filed on Aug. 22, 1997, provisional application No. 60/056,637, filed on Aug. 22, 1997, provisional application No. 60/056,903, filed on Aug. 22, 1997, provisional application No. 60/056,888, filed on Aug. 22, 1997, provisional application No. 60/056,879, filed on Aug. 22, 1997, provisional application No. 60/056,880, filed on Aug. 22, 1997, provisional application No. 60/056,894, filed on Aug. 22, 1997, provisional application No. 60/056,911, filed on Aug. 22, 1997, provisional application No. 60/056,636, filed on Aug. 22, 1997, provisional application No. 60/056,874, filed on Aug. 22, 1997, provisional application No. 60/056,910, filed on Aug. 22, 1997, provisional application No. 60/056,864, filed on Aug. 22, 1997, provisional application No. 60/056,631, filed on Aug. 22, 1997, provisional application No. 60/056,845, filed on Aug. 22, 1997, provisional application No. 60/056,892, filed on Aug. 22, 1997, provisional application No. 60/047,595, filed on May 23, 1997, provisional application No. 60/057,761, filed on Sep. 5, 1997, provisional application No. 60/047,599, filed on May 23, 1997, provisional application No. 60/047,588, filed on May 23, 1997, provisional application No. 60/047,585, filed on May 23, 1997, provisional application No. 60/047,586, filed on May 23, 1997, provisional application No. 60/047,590, filed on May 23, 1997, provisional application No. 60/047,594, filed on May 23, 1997, provisional application No. 60/047,589, filed on May 23, 1997, provisional application No. 60/047,593, filed on May 23, 1997, provisional application No. 60/047,614, filed on May 23, 1997, provisional application No. 60/043,578, filed on Apr. 11, 1997, provisional application No. 60/043,576, filed on Apr. 11, 1997, provisional application No. 60/047,501, filed on May 23, 1997, provisional application No. 60/043,670, filed on Apr. 11, 1997, provisional application No. 60/056,632, filed on Aug. 22, 1997, provisional application No. 60/056,664, filed on Aug. 22, 1997, provisional application No. 60/056,876, filed on Aug. 22, 1997, provisional application No. 60/056,881, filed on Aug. 22, 1997, provisional application No. 60/056,909, filed on Aug. 22, 1997, provisional application No. 60/056,875, filed on Aug. 22, 1997, provisional application No. 60/056,862, filed on Aug. 22, 1997, provisional application No. 60/058,887, filed on Aug. 22, 1997, provisional application No. 60/056,908, filed on Aug. 22, 1997, provisional application No. 60/048,964, filed on Jun. 6, 1997, provisional application No. 60/057,650, filed on Sep. 5, 1997, provisional application No. 60/056,884, filed on Aug. 22, 1997, provisional application No. 60/190,068, filed on Mar. 17, 2000, provisional application No. 60/057,669, filed on Sep. 5, 1997, provisional application No. 60/049,610, filed on Jun. 13, 1997, provisional application No. 60/061,060, filed on Oct. 2, 1997, provisional application No. 60/051,926, filed on Jul. 8, 1997, provisional application No. 60/052,874, filed on Jul. 16, 1997, provisional application No. 60/058,785, filed on Sep. 12, 1997, provisional application No. 60/055,724, filed on Aug. 18, 1997, provisional application No. 60/265,583, filed on Feb. 2, 2001, provisional application No. 60/040,762, filed on Mar. 14, 1997, provisional application No. 60/040,710, filed on Mar. 14, 1997, provisional application No. 60/050,934, filed on May 30, 1997, provisional application No. 60/048,100, filed on May 30, 1997, provisional application No. 60/048,357, filed on May 30, 1997, provisional application No. 60/048,189, filed on May 30, 1997, provisional application No. 60/057,765, filed on Sep. 5, 1997, provisional application No. 60/048,970, filed on Jun. 6, 1997, provisional application No. 60/068,368, filed on Dec. 19, 1997, provisional application No. 60/041,277, filed on Mar. 21, 1997, provisional application No. 60/042,344, filed on Mar. 21, 1997, provisional application No. 60/041,276, filed on Mar. 21, 1997, provisional application No. 60/041,281, filed on Mar. 21, 1997, provisional application No. 60/048,094, filed on May 30, 1997, provisional application No. 60/048,350, filed on May 30, 1997, provisional application No. 60/048,188, filed on May 30, 1997, provisional application No. 60/048,135, filed on May 30, 1997, provisional application No. 60/050,937, filed on May 30, 1997, provisional application No. 60/048,187, filed on May 30, 1997, provisional application No. 60/048,099, filed on May 30, 1997, provisional application No. 60/048,352, filed on May 30, 1997, provisional application No. 60/048,186, filed on May 30, 1997, provisional application No. 60/048,069, filed on May 30, 1997, provisional application No. 60/048,095, filed on May 30, 1997, provisional application No. 60/048,131, filed on May 30, 1997, provisional application No. 60/048,096, filed on May 30, 1997, provisional application No. 60/048,355, filed on May 30, 1997, provisional application No. 60/048,160, filed on May 30, 1997, provisional application No. 60/048,351, filed on May 30, 1997, provisional application No. 60/048,154, filed on May 30, 1997, provisional application No. 60/054,804, filed on Aug. 5, 1997, provisional application No. 60/056,370, filed on Aug. 19, 1997, provisional application No. 60/060,862, filed on Oct. 2, 1997, provisional application No. 60/042,726, filed on Apr. 8, 1997, provisional application No. 60/042,727, filed on Apr. 8, 1997, provisional application No. 60/042,728, filed on Apr. 8, 1997, provisional application No. 60/042,754, filed on Apr. 8, 1997, provisional application No. 60/042,825, filed on Apr. 8, 1997, provisional application No. 60/048,068, filed on May 30, 1997, provisional application No. 60/048,070, filed on May 30, 1997, provisional application No. 60/048,184, filed on May 30, 1997, provisional application No. 60/042,726, filed on Apr. 8, 1997, provisional application No. 60/042,727, filed on Apr. 8, 1997, provisional application No. 60/042,728, filed on Apr. 8, 1997, provisional application No. 60/042,754, filed on Apr. 8, 1997, provisional application No. 60/042,825, filed on Apr. 8, 1997, provisional application No. 60/044,039, filed on May 30, 1997, provisional application No. 60/048,093, filed on May 30, 1997, provisional application No. 60/048,190, filed on May 30, 1997, provisional application No. 60/050,935, filed on May 30, 1997, provisional application No. 60/048,101, filed on May 30, 1997, provisional application No. 60/048,356, filed on May 30, 1997, provisional application No. 60/056,250, filed on Aug. 29, 1997, provisional application No. 60/056,296, filed on Aug. 29, 1997, provisional application No. 60/056,293, filed on Aug. 29, 1997, provisional application No. 60/048,885, filed on Jun. 6, 1997, provisional application No. 60/349,375, filed on Jun. 6, 1997, provisional application No. 60/048,881, filed on Jun. 6, 1997, provisional application No. 60/048,880, filed on Jun. 6, 1997, provisional application No. 60/048,896, filed on Jun. 6, 1997, provisional application No. 60/049,020, filed on Jun. 6, 1997, provisional application No. 60/048,876, filed on Jun. 6, 1997, provisional application No. 60/048,895, filed on Jun. 6, 1997, provisional application No. 60/048,884, filed on Jun. 6, 1997, provisional application No. 60/148,894, filed on Jun. 6, 1997, provisional application No. 60/048,971, filed on Jun. 6, 1997, provisional application No. 60/048,964, filed on Jun. 6, 1997, provisional application No. 60/048,882, filed on Jun. 6, 1997, provisional application No. 60/048,899, filed on Jun. 6, 1997, provisional application No. 60/048,893, filed on Jun. 6, 1997, provisional application No. 60/048,900, filed on Jun. 6, 1997, provisional application No. 60/048,901, filed on Jun. 6, 1997, provisional application No. 60/048,892, filed on Jun. 6, 1997, provisional application No. 60/048,915, filed on Jun. 6, 1997, provisional application No. 60/049,019, filed on Jun. 6, 1997, provisional application No. 60/048,970, filed on Jun. 6, 1997, provisional application No. 60/048,972, filed on Jun. 6, 1997, provisional application No. 60/048,916, filed on Jun. 6, 1997, provisional application No. 60/049,373, filed on Jun. 6, 1997, provisional application No. 60/048,875, filed on Jun. 6, 1997, provisional application No. 60/049,374, filed on Jun. 6, 1997, provisional application No. 60/048,917, filed on Jun. 6, 1997, provisional application No. 60/048,949, filed on Jun. 6, 1997, provisional application No. 60/048,974, filed on Jun. 6, 1997, provisional application No. 60/048,883, filed on Jun. 6, 1997, provisional application No. 60/148,897, filed on Jun. 6, 1997, provisional application No. 60/048,898, filed on Jun. 6, 1997, provisional application No. 60/048,962, filed on Jun. 6, 1997, provisional application No. 60/048,963, filed on Jun. 6, 1997, provisional application No. 60/048,877, filed on Jun. 6, 1997, provisional application No. 60/048,878, filed on Jun. 6, 1997, provisional application No. 60/057,645, filed on Sep. 5, 1997, provisional application No. 60/057,642, filed on Sep. 5, 1997, provisional application No. 60/057,668, filed on Sep. 5, 1997, provisional application No. 60/057,635, filed on Sep. 5, 1997, provisional application No. 60/057,627, filed on Sep. 5, 1997, provisional application No. 60/057,667, filed on Sep. 5, 1997, provisional application No. 60/057,666, filed on Sep. 5, 1997, provisional application No. 60/157,764, filed on Sep. 5, 1997, provisional application No. 60/057,643, filed on Sep. 5, 1997, provisional application No. 60/057,769, filed on Sep. 5, 1997, provisional application No. 60/057,763, filed on Sep. 5, 1997, provisional application No. 60/057,650, filed on Sep. 5, 1997, provisional application No. 60/057,584, filed on Sep. 5, 1997, provisional application No. 60/057,647, filed on Sep. 5, 1997, provisional application No. 60/057,661, filed on Sep. 5, 1997, provisional application No. 60/057,662, filed on Sep. 5, 1997, provisional application No. 60/057,646, filed on Sep. 5, 1997, provisional application No. 60/057,654, filed on Sep. 5, 1997, provisional application No. 60/057,651, filed on Sep. 5, 1997, provisional application No. 60/057,644, filed on Sep. 5, 1997, provisional application No. 60/057,765, filed on Sep. 5, 1997, provisional application No. 60/057,762, filed on Sep. 5, 1997, provisional application No. 60/057,775, filed on Sep. 5, 1997, provisional application No. 60/057,648, filed on Sep. 5, 1997, provisional application No. 60/057,774, filed on Sep. 5, 1997, provisional application No. 60/057,649, filed on Sep. 5, 1997, provisional application No. 60/057,770, filed on Sep. 5, 1997, provisional application No. 60/057,771, filed on Sep. 5, 1997, provisional application No. 60/057,761, filed on Sep. 5, 1997, provisional application No. 60/057,760, filed on Sep. 5, 1997, provisional application No. 60/057,776, filed on Sep. 5, 1997, provisional application No. 60/057,778, filed on Sep. 5, 1997, provisional application No. 60/057,629, filed on Sep. 5, 1997, provisional application No. 60/057,628, filed on Sep. 5, 1997, provisional application No. 60/057,777, filed on Sep. 5, 1997, provisional application No. 60/057,634, filed on Sep. 5, 1997, provisional application No. 60/070,923, filed on Dec. 18, 1997, provisional application No. 60/184,836, filed on Feb. 24, 2000, provisional application No. 60/193,170, filed on Mar. 29, 2000, provisional application No. 60/049,547, filed on Jun. 13, 1997, provisional application No. 60/049,548, filed on Jun. 13, 1997, provisional application No. 60/049,549, filed on Jun. 13, 1997, provisional application No. 60/049,550, filed on Jun. 13, 1997, provisional application No. 60/049,566, filed on Jun. 13, 1997, provisional application No. 60/049,606, filed on Jun. 13, 1997, provisional application No. 60/049,607, filed on Jun. 13, 1997, provisional application No. 60/049,608, filed on Jun. 13, 1997, provisional application No. 60/049,609, filed on Jun. 13, 1997, provisional application No. 60/049,610, filed on Jun. 13, 1997, provisional application No. 60/049,611, filed on Jun. 13, 1997, provisional application No. 60/050,901, filed on Jun. 13, 1997, provisional application No. 60/052,989, filed on Jun. 13, 1997, provisional application No. 60/051,919, filed on Jul. 8, 1997, provisional application No. 60/055,984, filed on Aug. 18, 1997, provisional application No. 60/058,665, filed on Sep. 12, 1997, provisional application No. 60/058,668, filed on Sep. 12, 1997, provisional application No. 60/058,669, filed on Sep. 12, 1997, provisional application No. 60/058,750, filed on Sep. 12, 1997, provisional application No. 60/058,971, filed on Sep. 12, 1997, provisional application No. 60/058,972, filed on Sep. 12, 1997, provisional application No. 60/058,975, filed on Sep. 12, 1997, provisional application No. 60/060,834, filed on Oct. 2, 1997, provisional application No. 60/060,841, filed on Oct. 2, 1997, provisional application No. 60/060,844, filed on Oct. 2, 1997, provisional application No. 60/060,865, filed on Oct. 2, 1997, provisional application No. 60/061,059, filed on Oct. 2, 1997, provisional application No. 60/061,060, filed on Oct. 2, 1997, provisional application No. 60/051,480, filed on Jul. 1, 1997, provisional application No. 60/051,381, filed on Jul. 1, 1997, provisional application No. 60/058,663, filed on Sep. 12, 1997, provisional application No. 60/058,598, filed on Sep. 12, 1997, provisional application No. 60/239,899, filed on Oct. 13, 2000, provisional application No. 60/051,926, filed on Jul. 8, 1997, provisional application No. 60/052,793, filed on Jul. 8, 1997, provisional application No. 60/051,925, filed on Jul. 8, 1997, provisional application No. 60/051,929, filed on Jul. 8, 1997, provisional application No. 60/052,803, filed on Jul. 8, 1997, provisional application No. 60/052,732, filed on Jul. 8, 1997, provisional application No. 60/051,931, filed on Jul. 8, 1997, provisional application No. 60/051,932, filed on Jul. 8, 1997, provisional application No. 60/051,916, filed on Jul. 8, 1997, provisional application No. 60/051,930, filed on Jul. 8, 1997, provisional application No. 60/051,918, filed on Jul. 8, 1997, provisional application No. 60/051,920, filed on Jul. 8, 1997, provisional application No. 60/052,733, filed on Jul. 8, 1997, provisional application No. 60/052,795, filed on Jul. 8, 1997, provisional application No. 60/051,919, filed on Jul. 8, 1997, provisional application No. 60/051,928, filed on Jul. 8, 1997, provisional application No. 60/055,722, filed on Aug. 18, 1997, provisional application No. 60/055,723, filed on Aug. 18, 1997, provisional application No. 60/055,948, filed on Aug. 18, 1997, provisional application No. 60/055, 949, filed on Aug. 18, 1997, provisional application No. 60/055,953, filed on Aug. 18, 1997, provisional application No. 60/055,950, filed on Aug. 18, 1997, provisional application No. 60/055,947, filed on Aug. 18, 1997, provisional application No. 60/055,964, filed on Aug. 18, 1997, provisional application No. 60/056,360, filed on Aug. 18, 1997, provisional application No. 60/055,684, filed on Aug. 18, 1997, provisional application No. 60/055,984, filed on Aug. 18, 1997, provisional application No. 60/055,954, filed on Aug. 18, 1997, provisional application No. 60/058,785, filed on Sep. 12, 1997, provisional application No. 60/058,664, filed on Sep. 12, 1997, provisional application No. 60/058,660, filed on Sep. 12, 1997, provisional application No. 60/058,661, filed on Sep. 12, 1997, provisional application No. 60/180,909, filed on Feb. 8, 2000, provisional application No. 60/052,661, filed on Jul. 16, 1997, provisional application No. 60/052,872, filed on Jul. 16, 1997, provisional application No. 60/052,871, filed on Jul. 16, 1997, provisional application No. 60/052,874, filed on Jul. 16, 1997, provisional application No. 60/052,873, filed on Jul. 16, 1997, provisional application No. 60/052,870, filed on Jul. 16, 1997, provisional application No. 60/052,875, filed on Jul. 16, 1997, provisional application No. 60/053,440, filed on Jul. 22, 1997, provisional application No. 60/053,441, filed on Jul. 22, 1997, provisional application No. 60/053,442, filed on Jul. 22, 1997, provisional application No. 60/056,359, filed on Aug. 18, 1997, provisional application No. 60/055,725, filed on Aug. 18, 1997, provisional application No. 60/055,985, filed on Aug. 18, 1997, provisional application No. 60/055,952, filed on Aug. 18, 1997, provisional application No. 60/055,989, filed on Aug. 18, 1997, provisional application No. 60/056,361, filed on Aug. 18, 1997, provisional application No. 60/055,726, filed on Aug. 18, 1997, provisional application No. 60/055,724, filed on Aug. 18, 1997, provisional application No. 60/055,946, filed on Aug. 18, 1997, provisional application No. 60/055,683, filed on Aug. 18, 1997, provisional application No. 60/295,558, filed on Jun. 5, 2001, provisional application No. 60/054,212, filed on Jul. 30, 1997, provisional application No. 60/054,209, filed on Jul. 30, 1997, provisional application No. 60/054,234, filed on Jul. 30, 1997, provisional application No. 60/054,218, filed on Jul. 30, 1997, provisional application No. 60/054,214, filed on Jul. 30, 1997, provisional application No. 60/054,236, filed on Jul. 30, 1997, provisional application No. 60/054,215, filed on Jul. 30, 1997, provisional application No. 60/054,211, filed on Jul. 30, 1997, provisional application No. 60/054,217, filed on Jul. 30, 1997, provisional application No. 60/054,213, filed on Jul. 30, 1997, provisional application No. 60/055,968, filed on Aug. 18, 1997, provisional application No. 60/055,969, filed on Aug. 18, 1997, provisional application No. 60/055,972, filed on Aug. 18, 1997, provisional application No. 60/056,561, filed on Aug. 19, 1997, provisional application No. 60/056,534, filed on Aug. 19, 1997, provisional application No. 60/056,729, filed on Aug. 19, 1997, provisional application No. 60/056,543, filed on Aug. 19, 1997, provisional application No. 60/056,727, filed on Aug. 19, 1997, provisional application No. 60/056,554, filed on Aug. 19, 1997, provisional application No. 60/056,730, filed on Aug. 19, 1997, provisional application No. 60/238,291, filed on Oct. 6, 2000, provisional application No. 60/055,386, filed on Aug. 5, 1997, provisional application No. 60/054,807, filed on Aug. 5, 1997, provisional application No. 60/055,312, filed on Aug. 5, 1997, provisional application No. 60/055,309, filed on Aug. 5, 1997, provisional application No. 60/054,798, filed on Aug. 5, 1997, provisional application No. 60/055,310, filed on Aug. 5, 1997, provisional application No. 60/054,806, filed on Aug. 5, 1997, provisional application No. 60/054,809, filed on Aug. 5, 1997, provisional application No. 60/054,804, filed on Aug. 5, 1997, provisional application No. 60/054,803, filed on Aug. 5, 1997, provisional application No. 60/054,808, filed on Aug. 5, 1997, provisional application No. 60/055,311, filed on Aug. 5, 1997, provisional application No. 60/055,986, filed on Aug. 18, 1997, provisional application No. 60/055,970, filed on Aug. 18, 1997, provisional application No. 60/056,563, filed on Aug. 19, 1997, provisional application No. 60/056,557, filed on Aug. 19, 1997, provisional application No. 60/056,731, filed on Aug. 19, 1997, provisional application No. 60/056,365, filed on Aug. 19, 1997, provisional application No. 60/056,367, filed on Aug. 19, 1997, provisional application No. 60/056,370, filed on Aug. 19, 1997, provisional application No. 60/056,364, filed on Aug. 19, 1997, provisional application No. 60/056,366, filed on Aug. 19, 1997, provisional application No. 60/056,732, filed on Aug. 19, 1997, provisional application No. 60/056,371, filed on Aug. 19, 1997, provisional application No. 60/056,555, filed on Aug. 19, 1997, provisional application No. 60/056,556, filed on Aug. 19, 1997, provisional application No. 60/056,535, filed on Aug. 19, 1997, provisional application No. 60/056,629, filed on Aug. 19, 1997, provisional application No. 60/056,369, filed on Aug. 19, 1997, provisional application No. 60/056,628, filed on Aug. 19, 1997, provisional application No. 60/056,728, filed on Aug. 19, 1997, provisional application No. 60/056,368, filed on Aug. 19, 1997, provisional application No. 60/056,726, filed on Aug. 19, 1997, provisional application No. 60/089,510, filed on Jun. 16, 1998, provisional application No. 60/092,956, filed on Jul. 15, 1998, provisional application No. 60/056,270, filed on Aug. 29, 1997, provisional application No. 60/056,271, filed on Aug. 29, 1997, provisional application No. 60/056,247, filed on Aug. 29, 1997, provisional application No. 60/056,073, filed on Aug. 29, 1997, provisional application No. 60/262,066, filed on Jan. 18, 2001, provisional application No. 60/057,626, filed on Sep. 5, 1997, provisional application No. 60/057,663, filed on Sep. 5, 1997, provisional application No. 60/057,669, filed on Sep. 5, 1997, provisional application No. 60/058,667, filed on Sep. 12, 1997, provisional application No. 60/058,974, filed on Sep. 12, 1997, provisional application No. 60/058,973, filed on Sep. 12, 1997, provisional application No. 60/058,666, filed on Sep. 12, 1997, provisional application No. 60/090,112, filed on Jun. 22, 1998, provisional application No. 60/060,837, filed on Oct. 2, 1997, provisional application No. 60/060,862, filed on Oct. 2, 1997, provisional application No. 60/060,839, filed on Oct. 2, 1997, provisional application No. 60/060,866, filed on Oct. 2, 1997, provisional application No. 60/060,843, filed on Oct. 2, 1997, provisional application No. 60/060,836, filed on Oct. 2, 1997, provisional application No. 60/060,838, filed on Oct. 2, 1997, provisional application No. 60/060,874, filed on Oct. 2, 1997, provisional application No. 60/060,833, filed on Oct. 2, 1997, provisional application No. 60/060,884, filed on Oct. 2, 1997, provisional application No. 60/060,880, filed on Oct. 2, 1997, provisional application No. 60/244,591, filed on Nov. 1, 2000, provisional application No. 60/061,463, filed on Oct. 9, 1997, provisional application No. 60/061,529, filed on Oct. 9, 1997, provisional application No. 60/071,498, filed on Oct. 9, 1997, provisional application No. 60/061,527, filed on Oct. 9, 1997, provisional application No. 60/061,536, filed on Oct. 9, 1997, provisional application No. 60/061,532, filed on Oct. 9, 1997, provisional application No. 60/063,099, filed on Oct. 24, 1997, provisional application No. 60/063,088, filed on Oct. 24, 1997, provisional application No. 60/063,100, filed on Oct. 24, 1997, provisional application No. 60/063,387, filed on Oct. 24, 1997, provisional application No. 60/063,148, filed on Oct. 24, 1997, provisional application No. 60/063,386, filed on Oct. 24, 1997, provisional application No. 60/062,784, filed on Oct. 24, 1997, provisional application No. 60/063,091, filed on Oct. 24, 1997, provisional application No. 60/063,090, filed on Oct. 24, 1997, provisional application No. 60/063,089, filed on Oct. 24, 1997, provisional application No. 60/063,092, filed on Oct. 24, 1997, provisional application No. 60/063,111, filed on Oct. 24, 1997, provisional application No. 60/063,101, filed on Oct. 24, 1997, provisional application No. 60/063,109, filed on Oct. 24, 1997, provisional application No. 60/063,110, filed on Oct. 24, 1997, provisional application No. 60/063,098, filed on Oct. 24, 1997, provisional application No. 60/063,097, filed on Oct. 24, 1997, provisional application No. 60/239,893, filed on Oct. 13, 2000, provisional application No. 60/064,911, filed on Nov. 7, 1997, provisional application No. 60/064,912, filed on Nov. 7, 1997, provisional application No. 60/064,983, filed on Nov. 7, 1997, provisional application No. 60/064,900, filed on Nov. 7, 1997, provisional application No. 60/064,988, filed on Nov. 7, 1997, provisional application No. 60/064,987, filed on Nov. 7, 1997, provisional application No. 60/064,908, filed on Nov. 7, 1997, provisional application No. 60/064,984, filed on Nov. 7, 1997, provisional application No. 60/064,985, filed on Nov. 7, 1997, provisional application No. 60/066,094, filed on Nov. 17, 1997, provisional application No. 60/066,100, filed on Nov. 17, 1997, provisional application No. 60/066,089, filed on Nov. 17, 1997, provisional application No. 60/066,095, filed on Nov. 17, 1997, provisional application No. 60/066,090, filed on Nov. 17, 1997, provisional application No. 60/070,923, filed on Dec. 18, 1997, provisional application No. 60/068,007, filed on Dec. 18, 1997, provisional application No. 60/068,057, filed on Dec. 18, 1997, provisional application No. 60/068,006, filed on Dec. 18, 1997, provisional application No. 60/068,369, filed on Dec. 19, 1997, provisional application No. 60/068,367, filed on Dec. 19, 1997, provisional application No. 60/068,368, filed on Dec. 19, 1997, provisional application No. 60/068,169, filed on Dec. 19, 1997, provisional application No. 60/068,053, filed on Dec. 18, 1997, provisional application No. 60/068,064, filed on Dec. 18, 1997, provisional application No. 60/068,054, filed on Dec. 18, 1997, provisional application No. 60/068,008, filed on Dec. 18, 1997, provisional application No. 60/068,365, filed on Dec. 19, 1997, provisional application No. 60/070,704, filed on Jan. 7, 1998, provisional application No. 60/070,658, filed on Jan. 7, 1998, provisional application No. 60/070,692, filed on Jan. 7, 1998, provisional application No. 60/070,657, filed on Jan. 7, 1998, provisional application No. 60/232,150, filed on Sep. 12, 2000, provisional application No. 60/073,170, filed on Jan. 30, 1998, provisional application No. 60/073,167, filed on Jan. 30, 1998, provisional application No. 60/073,165, filed on Jan. 30, 1998, provisional application No. 60/073,164, filed on Jan. 30, 1998, provisional application No. 60/073,162, filed on Jan. 30, 1998, provisional application No. 60/073,161, filed on Jan. 30, 1998, provisional application No. 60/073,160, filed on Jan. 30, 1998, provisional application No. 60/073,159, filed on Jan. 30, 1998, provisional application No. 60/074,118, filed on Feb. 9, 1998, provisional application No. 60/074,157, filed on Feb. 9, 1998, provisional application No. 60/074,037, filed on Feb. 9, 1998, provisional application No. 60/074,141, filed on Feb. 9, 1998, provisional application No. 60/074,341, filed on Feb. 9, 1998, provisional application No. 60/076,053, filed on Feb. 26, 1998, provisional application No. 60/076,051, filed on Feb. 26, 1998, provisional application No. 60/076,054, filed on Feb. 26, 1998, provisional application No. 60/076,052, filed on Feb. 26, 1998, provisional application No. 60/076,057, filed on Feb. 26, 1998, provisional application No. 60/077,714, filed on Mar. 12, 1998, provisional application No. 60/077,686, filed on Mar. 12, 1998, provisional application No. 60/077,687, filed on Mar. 12, 1998, provisional application No. 60/077,696, filed on Mar. 12, 1998, provisional application No. 60/078,566, filed on Mar. 19, 1998, provisional application No. 60/078,576, filed on Mar. 19, 1998, provisional application No. 60/078,573, filed on Mar. 19, 1998, provisional application No. 60/078,574, filed on Mar. 19, 1998, provisional application No. 60/078,579, filed on Mar. 19, 1998, provisional application No. 60/080,314, filed on Apr. 1, 1998, provisional application No. 60/080,312, filed on Apr. 1, 1998, provisional application No. 60/078,578, filed on Mar. 19, 1998, provisional application No. 60/078,581, filed on Mar. 19, 1998, provisional application No. 60/078,577, filed on Mar. 19, 1998, provisional application No. 60/078,563, filed on Mar. 19, 1998, provisional application No. 60/080,313, filed on Apr. 1, 1998, provisional application No. 60/231,846, filed on Sep. 11, 2000, provisional application No. 60/085,093, filed on May 12, 1998, provisional application No. 60/085,094, filed on May 12, 1998, provisional application No. 60/085,105, filed on May 12, 1998, provisional application No. 60/085,180, filed on May 12, 1998, provisional application No. 60/085,927, filed on May 18, 1998, provisional application No. 60/085,906, filed on May 18, 1998, provisional application No. 60/085,920, filed on May 18, 1998, provisional application No. 60/085,924, filed on May 18, 1998, provisional application No. 60/085,922, filed on May 18, 1998, provisional application No. 60/085,923, filed on May 18, 1998, provisional application No. 60/085,921, filed on May 18, 1998, provisional application No. 60/085,925, filed on May 18, 1998, provisional application No. 60/085,928, filed on May 18, 1998, provisional application No. 60/263,681, filed on Jan. 24, 2001, provisional application No. 60/263,230, filed on Jan. 23, 2001, provisional application No. 60/089,507, filed on Jun. 16, 1998, provisional application No. 60/089,508, filed on Jun. 16, 1998, provisional application No. 60/089,509, filed on Jun. 16, 1998, provisional application No. 60/089,510, filed on Jun. 16, 1998, provisional application No. 60/090,112, filed on Jun. 22, 1998, provisional application No. 60/190,113, filed on Jun. 22, 1998, provisional application No. 60/092,921, filed on Jul. 15, 1998, provisional application No. 60/092,922, filed on Jul. 15, 1998, provisional application No. 60/092,956, filed on Jul. 15, 1998, provisional application No. 60/234,925, filed on Sep. 25, 2000, provisional application No. 60/350,898, filed on Jan. 25, 2002, provisional application No. 60/094,657, filed on Jul. 30, 1998, provisional application No. 60/095,486, filed on Aug. 5, 1998, provisional application No. 60/096,319, filed on Aug. 12, 1998, provisional application No. 60/095,454, filed on Aug. 6, 1998, provisional application No. 60/095,455, filed on Aug. 6, 1998, provisional application No. 60/097,917, filed on Aug. 25, 1998, provisional application No. 60/098,634, filed on Aug. 31, 1998, provisional application No. 60/101,546, filed on Sep. 23, 1998, provisional application No. 60/102,895, filed on Oct. 2, 1998, provisional application No. 60/108,207, filed on Nov. 12, 1998, provisional application No. 60/113,006, filed on Dec. 18, 1998, provisional application No. 60/112,809, filed on Dec. 17, 1998, provisional application No. 60/116,330, filed on Jan. 19, 1999, provisional application No. 60/119,468, filed on Feb. 10, 1999, provisional application No. 60/125,055, filed on Mar. 18, 1999, provisional application No. 60/128,693, filed on Apr. 9, 1999, provisional application No. 60/130,991, filed on Apr. 26, 1999, provisional application No. 60/137,725, filed on Jun. 7, 1999, provisional application No. 60/145,220, filed on Jul. 23, 1999, provisional application No. 60/149,182, filed on Aug. 17, 1999, provisional application No. 60/152,315, filed on Sep. 3, 1999, provisional application No. 60/152,317, filed on Sep. 3, 1999, provisional application No. 60/155,709, filed on Sep. 24, 1999, provisional application No. 60/163,085, filed on Nov. 2, 1999, provisional application No. 60/172,411, filed on Dec. 17, 1999, provisional application No. 60/215,139, filed on Jun. 30, 2000, provisional application No. 60/162,239, filed on Oct. 29, 1999, provisional application No. 60/215,138, filed on Jun. 30, 2000, provisional application No. 60/162,211, filed on Oct. 29, 1999, provisional application No. 60/215,131, filed on Jun. 30, 2000, provisional application No. 60/162,240, filed on Oct. 29, 1999, provisional application No. 60/219,666, filed on Jul. 21, 2000, provisional application No. 60/162,237, filed on Oct. 29, 1999, provisional application No. 60/215,134, filed on Jun. 30, 2000, provisional application No. 60/162,238, filed on Oct. 29, 1999, provisional application No. 60/215,130, filed on Jun. 30, 2000, provisional application No. 60/163,580, filed on Nov. 5, 1999, provisional application No. 60/215,137, filed on Jun. 30, 2000, provisional application No. 60/163,577, filed on Nov. 5, 1999, provisional application No. 60/215,133, filed on Jun. 30, 2000, provisional application No. 60/163,581, filed on Nov. 5, 1999, provisional application No. 60/221,366, filed on Jul. 27, 2000, provisional application No. 60/163,576, filed on Nov. 5, 1999, provisional application No. 60/221,367, filed on Jul. 27, 2000, provisional application No. 60/195,296, filed on Apr. 7, 2000, provisional application No. 60/164,344, filed on Nov. 9, 1999, provisional application No. 60/221,142, filed on Jul. 27, 2000, provisional application No. 60/164,835, filed on Nov. 12, 1999, provisional application No. 60/215,140, filed on Jun. 30, 2000, provisional application No. 60/164,744, filed on Nov. 12, 1999, provisional application No. 60/221,193, filed on Jul. 27, 2000, provisional application No. 60/164,735, filed on Nov. 12, 1999, provisional application No. 60/222,904, filed on Aug. 3, 2000, provisional application No. 60/164,825, filed on Nov. 12, 1999, provisional application No. 60/224,007, filed on Aug. 4, 2000, provisional application No. 60/164,834, filed on Nov. 12, 1999, provisional application No. 60/215,128, filed on Jun. 30, 2000, provisional application No. 60/164,750, filed on Nov. 12, 1999, provisional application No. 60/215,136, filed on Jun. 30, 2000, provisional application No. 60/166,415, filed on Nov. 19, 1999, provisional application No. 60/219,665, filed on Jul. 21, 2000, provisional application No. 60/166,414, filed on Nov. 19, 1999, provisional application No. 60/215,132, filed on Jun. 30, 2000, provisional application No. 60/164,731, filed on Nov. 12, 1999, provisional application No. 60/256,968, filed on Dec. 21, 2000, provisional application No. 60/226,280, filed on Aug. 18, 2000, provisional application No. 60/259,803, filed on Jan. 5, 2001, provisional application No. 60/226,380, filed on Aug. 18, 2000, provisional application No. 60/228,084, filed on Aug. 28, 2000, provisional application No. 60/231,968, filed on Sep. 12, 2000, provisional application No. 60/236,326, filed on Sep. 29, 2000, provisional application No. 60/234,211, filed on Sep. 20, 2000, provisional application No. 60/226,282, filed on Aug. 18, 2000, provisional application No. 60/232,104, filed on Sep. 12, 2000, provisional application No. 60/234,210, filed on Sep. 20, 2000, provisional application No. 60/259,805, filed on Jan. 5, 2001, provisional application No. 60/226,278, filed on Aug. 18, 2000, provisional application No. 60/259,678, filed on Jan. 5, 2001, provisional application No. 60/226,279, filed on Aug. 18, 2000, provisional application No. 60/226,281, filed on Aug. 18, 2000, provisional application No. 60/231,969, filed on Sep. 12, 2000, provisional application No. 60/259,516, filed on Jan. 4, 2001, provisional application No. 60/228,086, filed on Aug. 28, 2000, provisional application No. 60/259,804, filed on Jan. 5, 2001, provisional application No. 60/228,083, filed on Aug. 28, 2000, provisional application No. 60/304,444, filed on Jul. 12, 2001, provisional application No. 60/270,658, filed on Feb. 23, 2001, provisional application No. 60/304,417, filed on Jul. 12, 2001, provisional application No. 60/270,625, filed on Feb. 23, 2001, provisional application No. 60/304,121, filed on Jul. 11, 2001, provisional application No.

60/295,869, filed on Jun. 6, 2001, provisional application No. 60/325,209, filed on Sep. 28, 2001, provisional application No. 60/311,085, filed on Aug. 10, 2001, provisional application No. 60/330,629, filed on Oct. 26, 2001, provisional application No. 60/331,046, filed on Nov. 7, 2001, provisional application No. 60/358,554, filed on Feb. 22, 2002, provisional application No. 60/358,714, filed on Feb. 25, 2002.

ated Mar. 19, 2002), which is
ANTIBODIES TO HDPPA04 POLYPEPTIDE

STATEMENT UNDER 37 C.F.R. § 1.77(b)(4)

This application refers to a "Sequence Listing" listed below, which is provided as an electronic document on two identical compact discs (CD-R), labeled "Copy 1" and "Copy 2." These compact discs each contain the file "PS900SL.txt" (26,143,381 bytes, originally created Mar. 19, 2002), which is hereby incorporated by reference in its entirety herein. The sequence Listing may be viewed on an IBM-PC machine rung the MS-Windows operating system. This application also incorporates by reference all parts, including the Sequence Listing, of U.S. patent application Ser. No. 10/100,683 (filed Mar. 19, 2002) of which the present application claims benefit under 35 U.S.C. § 120.

FIELD OF THE INVENTION

The present invention relates to human secreted proteins/polypeptides, and isolated nucleic acid molecules encoding said proteins/polypeptides, useful for detecting, preventing, diagnosing, prognosticating, treating, and/or ameliorating diseases and disorders related to said protein/polypeptides (relatedness may be by direct or indirect association, by cause, by consequence, or by effect on said diseases and disorders). Antibodies that bind these polypeptides are also encompassed by the present invention. Also encompassed by the invention are vectors, host cells, and recombinant and synthetic methods for producing said polynucleotides, polypeptides, and/or antibodies. The invention further encompasses screening methods for identifying agonists and antagonists of polynucleotides and polypeptides of the invention. The present invention further encompasses methods and compositions for inhibiting or enhancing the production and function of the polypeptides of the present invention.

BACKGROUND OF THE INVENTION

Unlike bacterium, which exist as a single compartment surrounded by a membrane, human cells and other eukaryotes are subdivided by membranes into many functionally distinct compartments. Each membrane-bounded compartment, or organelle, contains different proteins essential for the function of the organelle. The cell uses "sorting signals," which are amino acid motifs located with the protein, to target proteins to particular cellular organelles.

One type of sorting signal, called a signal sequence, a signal peptide, or a leader sequence, directs a class of proteins to an organelle called the endoplasmic reticulum (ER). The ER separates the membrane-bounded proteins from all other types of proteins. Once localized to the ER, both groups of proteins can be further directed to another organelle called the Golgi apparatus. Here the Golgi distributes the proteins to vesicles, including secretory vesicles, the cell membrane, lysosomes, and the other organelles.

Proteins targeted to the ER by a signal sequence can be released into the extracellular space as a secreted protein. For example, vesicles containing secreted proteins can fuse with the cell membrane and release their contents into the extracellular space—a process called exocytosis. Exocytosis can occur constitutively or after receipt of a triggering signal. In the latter case, the proteins are stored in secretory vesicles (or secretory granules until exocytosis is triggered. Similarly, proteins residing on the cell membrane can also be secreted into the extracellular space by proteolytic cleavage of a "linker" holding the protein to the membrane.

Thus there exists a clear need for identifying and using novel secreted polynucleotides and polypeptides. Identification and sequencing of human genes is a major goal of modern scientific research. For example, by identifying genes and determining their sequences, scientists have been able to make large quantities of valuable human "gene products." These include human insulin, interferon, Factor VIII, tumor necrosis factor, human growth hormone, tissue plasminogen activator, and numerous other compounds. Additionally, knowledge of gene sequences can provide the key to treatment or cure of genetic diseases (such as muscular dystrophy and cystic fibrosis).

SUMMARY OF THE INVENTION

The present invention relates to human secreted proteins/polypeptides, and isolated nucleic acid molecules encoding said proteins/polypeptides, useful for detecting, preventing, diagnosing, prognosticating, treating, and/or ameliorating diseases and disorders related to said proteins/polypeptides (relatedness may be by direct or indirect association, or by cause, consequence, or effect on said diseases and disorders). Antibodies that bind these polypeptides are also encompassed by the present invention. Also encompassed by the invention are vectors, host cells, and recombinant and synthetic methods for producing said polynucleotides, polypeptides, and/or antibodies. The invention further encompasses screening methods for identifying agonists and antagonists of polynucleotides and polypeptides of the invention. The present invention further encompasses methods and compositions for inhibiting or enhancing the production and function of the polypeptides of the present invention.

DETAILED DESCRIPTION

Polynucleotides and Polypeptides of the Invention

Description of Table 1A

Table 1A summarizes information concerning certain polynucleotides and polypeptides of the invention. The first column provides the gene number in the application for each clone identifier. The second column provides a unique clone identifier, "Clone ID:", for a cDNA clone related to each contig sequence disclosed in Table 1A. Third column, the cDNA Clones identified in the second column were deposited as indicated in the third column (i.e. by ATCC™ Deposit No:Z and deposit date). Some of the deposits contain multiple different clones corresponding to the same gene. In the fourth column, "Vector" refers to the type of vector contained in the corresponding cDNA Clone identified in the second column. In the fifth column, the nucleotide sequence identified as "NT SEQ ID NO:X" was assembled from partially homologous ("overlapping") sequences obtained from the corresponding cDNA clone identified in the second column and, in some cases, from additional related cDNA clones. The overlapping sequences were assembled into a single contiguous sequence of high redundancy (usually three to five overlapping sequences at each nucleotide position), resulting in a final sequence identified as SEQ ID NO:X. In the sixth column, "Total NT Seq." refers to the total number of nucleotides in the contig sequence identified as SEQ ID NO:X." The deposited clone may contain all or most of these sequences, reflected by the nucleotide position indicated as "5' NT of Clone Seq." (seventh column) and the "3' NT of Clone Seq." (eighth column) of SEQ ID NO:X. In the ninth column, the nucleotide position of SEQ ID NO:X of the putative start codon (methionine) is identified as "5' NT of Start Codon."

Similarly, in column ten, the nucleotide position of SEQ ID NO:X of the predicted signal sequence is identified as "5' NT of First AA of Signal Pep." In the eleventh column the translated amino acid sequence, beginning with the methionine, is identified as "AA SEQ ID NO:Y," although other reading frames can also be routinely translated using known molecular biology techniques. The polypeptides produced by these alternative open reading frames are specifically contemplated by the present invention.

In the twelfth and thirteenth columns of Table 1A, the first and last amino acid position of SEQ ID NO:Y of the predicted signal peptide is identified as "First AA of Sig Pep" and "Last AA of Sig Pep." In the fourteenth column, the predicted first amino acid position of SEQ ID NO:Y of the secreted portion is identified as "Predicted First AA of Secreted Portion." The amino acid position of SEQ ID NO:Y of the last amino acid encoded by the open reading frame is identified in the fifteenth column as "Last AA of ORF".

SEQ ID NO:X (where X may be any of the polynucleotide sequences disclosed in the sequence listing) and the translated SEQ ID NO:Y (where Y may be any of the polypeptide sequences disclosed in the sequence listing) are sufficiently accurate and otherwise suitable for a variety of uses well known in the art and described further below. For instance, SEQ IS NO:X is useful for designing nucleic acid hybridization probes that will detect nucleic acid sequences contained in SEQ ID NO:X or the cDNA contained in the deposited clone. These probes will also hybridize to nucleic acid molecules in biological samples, thereby enabling a variety of forensic and diagnostic methods of the invention. Similarly, polypeptides identified from SEQ ID NO:Y may be used, for example, to generate antibodies, which bind specifically to proteins containing the polypeptides and the secreted proteins encoded by the cDNA clones identified in Table 1A and/or elsewhere herein.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequent identified as SEQ ID NO:X, and the predicted translated amino acid sequence identified as SEQ ID NO:Y, but also a sample of plasmid DNA containing a human cDNA of the invention deposited with the ATCC™, as set forth in Table 1A. The nucleotide sequence of each deposited plasmid can readily be determined by sequencing the deposited plasmid in accordance with known methods The predicted amino acid sequence can then be verified from such deposits. Moreover, the amino acid sequence of the protein encoded by a particular plasmid can also be directly determined by peptide sequencing or by expressing the protein in a suitable host cell containing the deposited human cDNA, collecting the protein, and determining its sequence Also provided in Table 1A is the name of the vector which contains the cDNA plasmid. Each vector is routinely used in the art. The following additional information is provided for convenience.

Vectors Lambda Zap (U.S. Pat. Nos. 5,128,256 and 5,286, 636), Uni-Zap XR (U.S. Pat. Nos. 5,128,256 and 5,286,636), Zap Express (U.S. Pat. Nos. 5,128,256 and 5,286,636), pBluescript (pBS) (Short, J. M. et al., *Nucleic Acids Res.* 16:7583-7600 (1988); Alting-Mees, M. A. and Short, J. M., *Nucleic Acids Res.* 17:9494 (1989)) and pBK (Alting-Mees, M. A., et al., *Strategies* 5:58-61 (1992)) are commercially available from Stratagene Cloning System, Inc. 11011 N. Torrey Pines Road, La Jolla, Calif., 92037. pBS contains an ampicillin resistance gene and pBK contains a neomycin resistance gene. Phagemid pBS may be excised from the Lambda Zap and Uni-Zap XR vectors, and phagemid pBK may be excised from the Zap Express vector. Both phagemids may be transformed into *E. coli* strain XL-1 Blue, also available from Stratagene.

Vectors pSport1, pCMVSport 1.0, pCMVSport 2.0 and pCMVSport 3.0, were obtained from Life Technologies, Inc., P.O. Box 6009, Gaithersburg, Md. 20897. All Sport vectors contain an ampicillin resistance gene and may be transformed into *E. coli* strain DH10B also available from Life Technologies. See, for instance, Gruber, C. E., et al., *Focus* 15:59 (1993). Vector lafmid BA (Bento Soares, Columbia University, New York. N.Y.) contains an ampicillin resistance gene and can be transformed into *E. coli* strain XL-1 Blue. Vector pCR®2.1, which is available from Invitrogen, 1600 Faraday Avenue, Carlsbad, Calif. 92008, contains an ampicillin resistance gene and may be transformed into *E. coli* strain DH10B, available from Life Technologies. See, for instance, Clark, J. M., Nuc Acids Res. 16:9677-9686 (1988) and Mead, D. et al., Bio/Technology 9: (1991).

The present invention also relates to the genes corresponding to SEQ ID NO:X, SEQ ID NO:Y, and/or a deposited cDNA (cDNA Clone ID). The corresponding gene can be isolated in accordance with known methods using the sequence information disclosed herein. Such methods include, but are not limited to, preparing probes or primers from the disclosed sequence and identifying or amplifying the corresponding gene from appropriate sources of genomic material.

Also provided in the present invention are allelic variants, orthologs, and/or species homologs. Procedures known in the art can be used to obtain full-length genes, allelic variants, splice variants full-length coding portions, orthologs, and/or species homologs of genes corresponding to SEQ ID NO:X and SEQ ID NO:Y using information from the sequences disclosed herein or the clones deposited with the ATCC™. For example, allelic variants and/or species homologs may be isolated and identified by making suitable probes or primers from the sequences provided herein and screening a suitable nucleic acid source for allelic variants and/or the desired homologue.

The present invention provides a polynucleotide comprising, or alternatively consisting of the nucleic acid sequence of SEQ ID NO:X and/or a cDNA contained in ATCC™ Deposit No.Z. The present invention also provides a polypeptide comprising, or alternatively, consisting of, the polypeptide sequence of SEQ ID NO:Y, a polypeptide encoded by SEQ ID NO:X, and/or a polypeptide encoded by a cDNA contained in ATCC™ deposit No.Z. Polynucleotides encoding a polypeptide comprising, or alternatively consisting of the polypeptide sequence of SEQ ID NO:Y, a polypeptide encoded by SEQ ID NO:X and/or a polypeptide encoded by the cDNA contained in ATCC™ Deposit No.Z, are also encompassed by the invention. The present invention further encompasses a polynucleotide comprising, or alternatively consisting of the complement of the nucleic acid sequence of SEQ ID NO:X, and/or the complement of the coding strand of the cDNA contained in ATCC™ Deposit No.Z.

Description of Table 1B (Comprised of Tables 1B.1 and 1B.2)

Table 1B.1 and Table 1B.2 summarize some of the polynucleotides encompassed by the invention (including cDNA clones related to the sequences (Clone ID:), contig sequences (contig identifier (Contig ID:) and contig nucleotide sequence identifiers (SEQ ID NO:X)) and further summarizes certain characteristics of these polynucleotides and the polypeptides encoded thereby. The first column of Tables 1B.1 and 1B.2 provide the gene numbers in the application for each clone identifier. The second column of Tables 1B.1 and 1B.2 provide unique clone identifiers, "Clone ID:", for cDNA clones related to each contig sequence disclosed in Table 1A and/or Table 1B. The third column of Tables 1B.1 and 1B.2 provide unique contig identifiers, "Contig ID:" for each of the contig sequences disclosed in these tables. The fourth column of Tables 1B.1 and 1B.2 provide the sequence identifiers, "SEQ ID NO:X", for each of the contig sequences disclosed in Table 1A and/or 1B.

Table 1B.1

The fifth column of Table 1B.1, "ORF (From-To)", provides the location (i.e., nucleotide position numbers) within the polynucleotide sequence of SEQ ID NO:X that delineates the preferred open reading frame (ORF) that encodes the amino acid sequence shown in the sequence listing and referenced in Table 1B.1 as SEQ ID NO:Y (column 6). Column 7 of Table 1B.1 lists residues comprising predicted epitopes contained in the polypeptides encoded by each of the preferred ORFs (SEQ ID NO:Y). Identification of potential immunogenic regions was performed according to the method of Jameson and Wolf (CABIOS, 4: 181-186 (1988)); specifically, the Genetics Computer Group (GCG) implementation of this algorithm, embodied in the program PEPTIDESTRUCTURE (Wisconsin Package v10.0, Genetics Computer Group (GCG), Madison, Wis.). This method returns a measure of the probability that a given residue is found on the surface of the protein, Regions where the antigenic index score is greater than 0.9 over at least 6 amino acids are indicated in Table 1B.1 as "Predicted Epitopes". In particular embodiments, polypeptides of the invention comprise, or alternatively consist of, one, two, three, four, five or more of the predicted epitopes described in Table 1B.1. It will be appreciated that depending on the analytical criteria used to predict antigenic determinants, the exact address of the determinant may vary slightly. Column 8 of Table 1B.1 ("Cytologic Band") provides the chromosomal location of polynucleotides corresponding to SEQ ID NO:X. Chromosomal location was determined by finding exact matches to EST and cDNA sequences contained in the NCBI (National Center for Biotechnology Information) UniGene database. Given a presumptive chromosomal location, disease locus association was determined by comparison with the Morbid Map, derived from Online Mendelian Inheritance in Man (Online Mendelian Inheritance in Man, OMIM™ McKusick-Nathans Institute for Genetic Medicine, Johns Hopkins University (Baltimore, Md.) and National Center for Biotechnology Information, National Library of Medicine (Bethesda, Md.) 2000. World Wide Web URL: http://www.ncbr.nlm.nih.gov/omim/). If the putative chromosomal location of the Query overlaps with the chromosomal location of a Morbid Map entry, an OMIM identification number is disclosed in Table 1B.1, column 9 labeled "OMIM Disease Reference(s)". A key to the OMIM reference identification numbers is provided in Table 5.

Table 1B.2

Column of Table 1B.2, "Tissue Distribution" shows the expression profile of tissue, cells, and or cell line libraries which express the polynucleotides of the invention. The first code number shown in Table 1B.2 column 5 (preceding the colon), represents the tissue/cell source identifier code corresponding to the key provided in Table 4. Expression of these polynucleotides was not observed in the other tissues and/or cell libraries tested. The second number in column 5 (following the colon), represents the number of times a sequence corresponding to the reference polynucleotide sequence (e.g., SEQ ED NO:X) was identified in the corresponding tissue/cell source. Those tissue/cell source identifier codes in which the first two letters are "AR" designate information generated using DNA array technology. Utilizing this technology, cDNAs were amplified by PCR and then transferred, in duplicate, onto the array. Gene expression was assayed through hybridization of first strand cDNA probes to the DNA array. cDNA probes were generated from total RNA extracted from a variety of different tissues and cell lines. Probe synthesis was performed in the presence of $^{33}P$ dCTP, using oligo(dT) to prime reverse transcription. After hybridization high stringency washing conditions were employed to remove non-specific hybrids from the array. The remaining signal, emanating from each gene target, was measured using a Phosphorimager. Gene expression was reported as Phosphor Stimulating Luminescence (PSL) which reflects the level of phosphor signal generated from the probe hybridized to each of the gene targets represented on the array. A local background signal subtraction was performed before the total signal generated from each array was used to normalize gene expression between the different hybridizations. The value presented after "[array code]:" represents the mean of the duplicate values, following background subtraction and probe normalization. One of skill in the art could routinely use this information to identify normal and/or diseased tissue(s) which show a predominant expression pattern of the corresponding polynucleotide of the invention or to identify polynucleotides which show predominant and/or specific tissue and/or cell expression.

Description of Table 1C

Table 1C summarizes additional polynucleotides encompassed by the invention (including cDNA clones related to the sequences (Clone ID:), contig sequences (contig identifier (Contig ID:) contig nucleotide sequence identifiers (SEQ ID NO:X)), and genomic sequences (SEQ ID NO:B). The first column provides a unique clone identifier, "Clone ID:", to a cDNA clone related to each contig sequence. The second column provides the sequence identifier, "SEQ IS NO:X", for each contig sequence. The third column provides a unique contig identifier, "Contig ID:" for each contig sequence. The fourth column provides a BAC identifier "BAC ID NO:A" for the BAC clone referenced in the corresponding row of the table. The fifth column provides the nucleotide sequence identifier, "SEQ ID NO:B" for a fragment of the BAC clone identified in column four of the corresponding row of the table The sixth column, "Exon From-To", provides the location (i.e., nucleotide position numbers) within the polynucleotide sequence of SEQ ID NO:B which delineate certain polynucleotides of the invention that are also exemplary members of polynucleotide sequences that encode polypeptides of the invention (e.g., polypeptides containing amino acid sequences encoded by the polynucleotide sequences delineated in column six, and fragments and variants thereof).

Description of Table 1D

Table 1D, in preferred embodiments, the present invention encompasses a method of detecting, preventing, treating, and/or ameliorating a disease or disorder listed as listed in the "Preferred Indications" column of Table 1D (below); comprising administering to a patient (in which such detection, prevention, treatment, and/or amelioration is desired) a protein, nucleic acid, or antibody of the invention (or fragment or variant thereof) represented by Table 1A and Table 1D (in the same row as the disease or disorder to be treated is listed in the "Preferred Indications" column of Table 1D) in an amount effective to detect, prevent treat, or ameliorate the disease or disorder.

As indicated in Table 1D, the polynucleotides, polypeptides, agonists, or antagonists of the present invention (including antibodies) can be used in assays to test for one or more biological activities. If these polynucleotides and polypeptides do exhibit activity in a particular assay, it is likely that these molecules may be involved in the diseases associated with the biological activity. Thus, the polynucleotides or polypeptides, or agonists or an agonists thereof (including antibodies) could be used to prevent, treat, or ameliorate the associated disease.

The present invention encompasses methods of detecting, preventing, diagnosing, prognosticating, treating, and/or ameliorating a disease or disorder. In preferred embodiments, the present invention encompasses a method of detecting, diagnosing, treating, preventing, or ameliorating a disease or disorder listed in the "Preferred Indications" column of Table 1D, comprising administering to a patient in which such treatment, prevention or amelioration is desired a protein, nucleic acid, or antibody of the invention (or fragment or variant thereof) in an amount effective to treat, prevent, or ameliorate the disease or disorder. The first and second columns of Table 1D show the "Gene No." and "cDNA Clone ID No.", respectively, indicating certain nucleic acids and proteins (or antibodies against the same) of the invention (including polynucleotide, polypeptide, and antibody fragments or variants thereof) that may be used in detecting, preventing, diagnosing, prognosticating, treating, and/or ameliorating the disease(s) or disorder(s) indicated in the corresponding row in Column 3 of Table 1D.

In another embodiment, the present invention also encompasses methods of preventing, treating, diagnosing, or ameliorating a disease or disorder listed in the "Preferred Indications" column of Table 1D; comprising administering to a patient combinations of the proteins, nucleic acids, or antibodies of the invention (or fragments or variants thereof), sharing similar indications as shown in the corresponding rows in Column 3 of Table 1D.

The recitation of "Cancer" in the "Preferred Indication" column describes diseases, disorders, and/or conditions that may be treated, prevented, diagnosed, or ameliorated by a protein, nucleic acid, or antibody of the invention (or fragment or variant thereof).

The recitation of "Cancer" in the "Preferred Indication" column indicates that the corresponding nucleic acid and protein, or antibody against the same, of the invention (or fragment or variant thereof) may be used for example, to diagnose, treat, prevent, and/or ameliorate diseases and/or disorders relating to neoplastic diseases (e.g., leukemias, cancers, and/or as described below under "Hyperproliferative Disorders").

In specific embodiments, a protein, nucleic acid, or antibody of the invention (or fragment or variant thereof) having a "Cancer" recitation in the "Preferred Indication" column of Table 1D may be used for example, to diagnose, treat, prevent, and/or ameliorate a neoplasm located in a tissue selected from the group consisting of: colon, abdomen, bone, breast, digestive system, liver, pancreas, prostate, peritoneum, lung, blood (e.g. leukemia), endocrine glands (adrenal, parathyroid, pituitary, testicles, ovary, thymus, thyroid), uterus, eye, head and neck, nervous (central and peripheral), lymphatic system, pelvic, skin, soft tissue, spleen, thoracic, and urogenital.

In specific embodiments, a protein, nucleic acid, or antibody of the invention (or fragment or variant thereof) having a "Cancer" recitation in the "Preferred Indication" column of Table 1D, may be used for example, to diagnose, treat, prevent, and/or ameliorate a pre-neoplastic condition, selected from the group consisting of: hyperplasia (e.g., endometria), hyperplasia and/or as described in the section entitled "Hyperproliferative Disorders"), metaplasia (e.g., connective tissue metaplasia, atypical metaplasia, and/or as described in the section entitled "Hyperproliferative Disorders"), and/or dysplasia e.g., cervical dysplasia, and bronchopulmonary dysplasia).

In another specific embodiment, a protein, nucleic acid, or antibody of the invention (or fragment or variant thereof) having a "Cancer" recitation in the "Preferred Indication" column if Table 1D, may be used for example, to diagnose, treat, prevent, and/or ameliorate a benign dysproliferative disorder selected from the group consisting of: benign tumor, fibrocystic conditions, tissue hypertrophy, and/or as described in the section entitled "Hyperproliferative Disorders".

The recitation of "Immune/Hematopoietic" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

In specific embodiments, a protein, nucleic acid, or antibody of the invention (or fragment or variant thereof) having the "Immune/Hematopoietic" recitation in the "Preferred Indication" column of Table 1D, may be used for example, to diagnose, treat, prevent, and/or ameliorate a disease or disorder selected from the group consisting of: anemia pancytopenia, leukopenia, thrombocytopenia, leukemias, Hodgkin's disease, non-Hodgkin'Hodgkin's lymphoma, acute lymphocytic anemia (ALL), plasmacytomas, multiple myeloma, Burkitt's lymphoma, arthritis, asthma, AIDS, autoimmune disease, rheumatoid arthritis, granulomatous disease, immune deficiency, inflammatory bowel disease, sepsis, neutropenia, neutrophilia, psoriasis, immune reactions to transplanted organs and tissues, systemic lupus erythematosis, hemophilia, hypercoagulation, diabetes mellitus, endocarditis, meningitis, Lyme Disease, and allergies.

The recitation of "Reproductive" in the "Preferred Indications" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the reproductive system (e.g., as described below under "Reproductive System Disorders").

In specific embodiments, a protein, nucleic acid, or antibody of the invention (or fragment or variant thereof) having a "Reproductive" recitation in the "Preferred Indication" column of Table 1D, may be used for example, to diagnose, treat, prevent, and/or ameliorate a disease of disorder selected from the group consisting of: cryptorchism, prostatitis, inguinal hernia, varicocele, leydig cell tumors, verrucous carcinoma, prostatitis, malacoplakia, Peyronie's disease, penile carcinoma, squamous cell hyperplasia, dysmenorrhea, ovarian adenocarcinoma, Turner's syndrome, mucopurulent cervicitis, Sertoli-leydig tumors, ovarian cancer, uterine cancer, pelvic inflammatory disease, testicular cancer, prostate cancer, Klinefelter's syndrome, Young's syndrome, premature ejaculation, diabetes mellitus, cystic fibrosis, Kartagener's syndrome, testicular atrophy, testicular feminization, anorchia, ectopic testis, epididymitis, orchitis, gonorrhea, syphilis, testicular torsion, vasitis nodosa, germ cell tumors, stromal tumors, dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding, cervicitis, chronic cervicitis, mucopurulent cervicitis, cervical dysplasia, cervical polyps, Nabothian cysts, cervical erosion, cervical incompetence, cervical neoplasms, pseudohermaphroditism, and premenstrual syndrome.

The recitation of "Musculoskeletal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the immune system (e.g., as described below under "Immune Activity").

In specific embodiments, a protein, nucleic acid, or antibody of the invention (or fragment or variant thereof) having a "Musculoskeletal" recitation in the "Preferred Indication" column of Table 1D, may be used for example, to diagnose, treat, prevent, and/or ameliorate a disease or disorder selected from the group consisting of: bone cancers (e.g., osteochondromas, benign chondromas, chondroblastoma, chondromyxoid fibromas, osteoid osteomas, giant cell tumors, multiple myeloma, osteosarcomas), Paget's Disease, rheumatoid arthritis, systemic lupus erythematosus, osteomyelitis, Lyme Disease, gout, bursitis, tendonitis, osteoporosis, osteoarthritis, muscular dystrophy, mitochondrial myopathy, cachexia, and multiple sclerosis.

The recitation of "Cardiovascular" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the cardiovascular system (e.g., as described below under "Cardiovascular Disorders").

In specific embodiments, a protein, nucleic acid, or antibody of the invention (or fragment or variant thereof) having a "Cardiovascular" recitation in the "Preferred Indication" column of Table 1D, may be used for example, to diagnose, treat, prevent, and/or ameliorate a disease or disorder selected from the group consisting of: myxomas, fibromas, rhabdomyomas, cardiovascular abnormalities (e.g., congenital heart defects, cerebral arteriovenous malformations, septal defects), heart disease (e.g., heart failure, congestive heart disease, arrhythmia, tachycardia, fibrillation, pericardial Disease, endocarditis), cardiac arrest, heart valve disease (e.g., stenosis, regurgitation, prolapse), vascular disease (e.g., hypertension, coronary artery disease, angina, aneurysm, arteriosclerosis, peripheral vascular disease), hyponatremia, hypernatremia, hypokalemia, and hyperkalemia.

The recitation of "Mixed Fetal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders").

In specific embodiments, a protein, nucleic acid, or antibody of the invention (or fragment or variant thereof) having a "Mixed Fetal" recitation in the "Preferred Indication" column of Table 1D, may be used for example, to diagnose, treat, prevent, and/or ameliorate a disease or disorder selected from the group consisting of: spina bifida, hydranencephaly, neurofibromatosis, fetal alcohol syndrome, diabetes mellitus, PKU, Down's syndrome, Patau syndrome, Edwards syndrome, Turner syndrome, Apert syndrome, Carpenter syndrome, Conradi syndrome, Crouzon syndrome, cutis laxa, Cornelia de Lange syndrome, Ellis-van Creveld syndrome, Holt-Oram syndrome, Kartagener syndrome, Meckel-Gruber syndrome, Noonan syndrome, Pallister-Hall syndrome, Rubinstein-Taybi syndrome, Scimitar syndrome, Smith-Lemli-Opitz syndrome, thromocytopenia-absent radius (TAR) syndrome, Treacher Collins syndrome, Williams syndrome, Hirschsprung's disease, Meckel's diverticulum, polycystic kidney disease, Turner's syndrome, and gonadal dysgenesis, Klippel-Feil syndrome, Ostogenesis imperfecta, muscular dystrophy, Tay-Sachs disease, Wilm's tumor, neuroblastoma, and retinoblastoma.

The recitation of "Excretory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and renal disorders (e.g., as described below under "Renal Disorders").

In specific embodiments, a protein, nucleic acid, or antibody of the invention (or fragment or variant thereof) having a "Excretory" recitation in the "Preferred Indication" column of Table 1D, may be used for example, to diagnose, treat, prevent, and/or ameliorate a disease or disorder selected from the group consisting of: bladder cancer, prostate cancer, benign prostatic hyperplasia, bladder disorders (e.g., urinary incontinence, urinary retention, urinary obstruction, urinary tract Infections, interstitial cystitis, prostatitis, neurogenic bladder, hematuria), renal disorders (e.g., hydronephrosis, proteinuria, renal failure, pyelonephritis, urolithiasis, reflux nephropathy, and unilateral obstructive uropathy).

The recitation of "Neural/Sensory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the nervous system (e.g., as described below under "Neural Activity and Neurological Diseases").

In specific embodiments, a protein, nucleic acid, or antibody of the invention (or fragment or variant thereof) having a "Neural/Sensory" recitation in the "Preferred Indication" column of Table 1D, may be used for example, to diagnose, treat, prevent, and/or ameliorate a disease or disorder selected from the group consisting of: brain cancer (e.g., brain stem glioma, brain tumors, central nervous system (Primary) lymphoma, central nervous system lymphoma, cerebellar astrocytoma, and cerebral astrocytoma, neurodegenerative disorders (e.g., Alzheimer's Disease, Creutzfeldt-Jakob Disease, Parkinson's Disease, and Idiopathic Presenile Dementia), encephalomyelitis, cerebral malaria, meningitis, metabolic brain diseases (e.g., phenylketonuria and pyruvate carboxylase deficiency), cerebellar ataxia, ataxia telangiectasia, and AIDS Dementia Complex, schizophrenia, attention deficit disorder, hyperactive attention deficit disorder, autism, and obsessive compulsive disorders.

The recitation of "Respiratory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders").

In specific embodiments, a protein, nucleic acid, or antibody of the invention (or fragment or variant thereof) having a "Respiratory" recitation in the "Preferred Indication" column of Table 1D, may be used for example, to diagnose, treat, prevent, and/or ameliorate a disease or disorder selected from the group consisting of: cancers of the respiratory system such as larynx cancer, pharynx cancer, trachea cancer, epiglottis cancer, lung cancer, squamous cell carcinomas, small cell (oat cell) carcinomas, large cell carcinomas, and adenocarcinomas. Allergic reactions, cystic fibrosis, sarcoidosis, histiocytosis X, infiltrative lung diseases (e.g., pulmonary fibrosis and lymphoid interstitial pneumonia), obstructive airway diseases (e.g., asthma, emphysema, chronic or acute bronchitis), occupational lung diseases (e.g., silicosis and asbestosis), pneumonia, and pleurisy.

The recitation of "Endocrine" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders"), renal disorders (e.g., as described below under "Renal Disorders"), and disorders of the endocrine system (e.g., as described below under "Endocrine Disorders".

In specific embodiments, a protein, nucleic acid, or antibody of the invention (or fragment or variant thereof) having an "Endocrine" recitation in the "Preferred Indication" column of Table 1D, may be used for example, to diagnose, treat, prevent, and/or ameliorate a disease or disorder selected from the group consisting of: cancers of endocrine tissues and organs (e.g., cancers of the hypothalamus, pituitary gland, thyroid gland, parathyroid glands, pancreas, adrenal glands, ovaries, and testes), diabetes (e.g., diabetes insipidus, type I and type II diabetes mellitus), obesity, disorders related to pituitary glands (e.g., hyperpituitarism, hypopituitarism, and pituitary dwarfism), hypothyroidism, hyperthyroidism, goiter, reproductive disorders (e.g. male and female infertility), disorders related to adrenal glands (e.g., Addison's Disease, corticosteroid deficiency, and Cushing's Syndrome), kidney cancer (e.g., hypemephroma, transitional cell cancer, and Wilm's tumor), diabetic nephropathy, interstitial nephritis, polycystic kidney disease, glomerulonephritis (e.g., IgM mesangial proliferative glomerulonephritis and glomerulonephritis caused by autoimmune disorders; such as Goodpasture's syndrome), and nephrocalcinosis.

The recitation of "Digestive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the gastrointestinal system (e.g., as described below under "Gastrointestinal Disorders".

In specific embodiments, a protein, nucleic acid, or antibody of the invention (or fragment or variant thereof) having a "Digestive" recitation in the "Preferred Indication" column of Table 1D, may be used for example, to diagnose, treat, prevent, and/or ameliorate a disease or disorder selected from the group consisting of: ulcerative colitis, appendicitis, Crohn's disease, hepatitis, hepatic encephalopathy, portal hypertension, cholelithiasis, cancer of the digestive system (e.g., biliary tract cancer, stomach cancer, colon cancer, gastric cancer, pancreatic cancer, cancer of the bile duct, tumors of the colon (e.g., polyps or cancers), and cirrhosis), pancreatitis, ulcerative disease, pyloric stenosis, gastroenteritis, gastritis, gastric atropy, benign tumors of the duodenum, distension, irritable bowel syndrome, malabsorption, congenital disorders of the small intestine, bacterial and parasitic infection, megacolon, Hirschsprung's disease, aganglionic megacolon, acquired megacolon, colitis, anorectal disorders (e.g., anal fistulas, hemorrhoids), congenital disorders of the liver (e.g., Wilson's disease, hemochromatosis, cystic fibrosis, biliary atresia, and alpha1-antitrypsin deficiency), portal hypertension, cholelithiasis, and jaundice.

The recitation of "Connective/Epithelial" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), cellular and genetic abnormalities (e.g., as described below under "Diseases at the Cellular Level"), angiogenesis (e.g., as described below under "Anti-Angiogenesis Activity"), and or to promote or inhibit regeneration (e.g., as described below under "Regeneration"), and wound healing (e.g., as described below under "Wound Healing and Epithelial Cell Proliferation").

In specific embodiments, a protein, nucleic acid, or antibody of the invention (or fragment or variant thereof) having a "Connective/Epithelial" recitation in the "Preferred Indication" column of Table 1D, may be used for example, to diagnose, treat, prevent, and/or ameliorate a disease or disorder selected from the group consisting of: connective tissue metaplasia, mixed connective tissue disease, focal epithelial hyperplasia, epithelial metaplasia, mucoepithelial dysplasia, graft v. host disease, polymyositis, cystic hyperplasia, cerebral dysplasia, tissue hypertrophy, Alzheimer's disease, lymphoproliferative disorder, Waldenstron's macroglobulinemia, Crohn's disease, pernicious anemia, idiopathic Addison's disease, glomerulonephritis, bullous pemphigoid, Sjogren's syndrome, diabetes mellitus, cystic fibrosis, osteoblastoma, osteoclastoma, osteosarcoma, chondrosarcoma, osteoporosis, osteocarthritis, periodontal disease, wound healing, relapsing polychondritis, vasculitis, polyarteritis nodosa, Wegener's granulamatosis, cellulitis, rheumatoid arthritis, psoriatic arthritis, discoid lupus erythematosus, systemic lupus erythematosus, scleroderma, CREST syndrome, Sjogren's syndrome, polymyositis, dermatomyositis, mixed connective tissue disease, relapsing polychondritis, vasculitis, Henoch-Schonlein syndrome, erythema nodosum, polyarteritis nodosa, temporal (giant cell) arteritis, Takayasu's arteritis, Wegener's granulomatosis, Reiter's syndrome, Behcet's syndrome, ankylosing spondylitis, cellulitis, keloids, Ehler Danlos syndrome, Marfan syndrome, pseudoxantoma elasticum, osteogenese imperfecta, chondrodysplasias, epidermolysis bullosa, Alport syndrome, and cutis laxa.

Description of Table 1E

Table 1E provides information related to biological activities and preferred indications for polynucleotides and polypeptides of the invention (including antibodies, agonists, and/or antagonists thereof). Table 1E also provides information related to assays which may be used to test polynucleotides and polypeptides of the invention (including antibodies, agonists, and/or antagonists thereof) for the corresponding biological activities. The first column ("Gene No.") provides the gene number in the application for each clone identifier. The second column ("cDNA Clone ID:") provides the unique clone identifier for each clone as previously described and indicated in Tables 1A, 1B, 1C, and 1D. The third column ("AA SEQ ID NO:Y") indicates the Sequence Listing SEQ ID Number for polypeptide sequences encoded by the corresponding cDNA clones (also as indicated in Tables 1A, 1B, and 2). The fourth column ("Biological Activity") indicates a biological activity corresponding to the indicated polypeptides (or polynucleotides encoding said polypeptides). The fifth column ("Exemplary Activity Assay") further describes the corresponding biological activity and provides information pertaining to the various types of assays which may be performed to test, demonstrate, or quantify the corresponding biological activity. The sixth column ("Preferred Indictions") describes particular embodiments of the invention and indications (e.g. pathologies, diseases, disorders, abnormalities, etc.) for which polynucleotides and polypeptides of the invention (including antibodies, agonists, and/or antagonists thereof) may be used in detecting, preventing, diagnosing, prognosticating, treating, and/or ameliorating.

Table 1E describes the use of FMAT technology, inter alia, for testing or demonstrating various biological activities. Fluorometric microvolume assay technology (FMAT) is a fluorescence-based system which provides a means to perform nonradioactive cell- and bead-based assays to detect activation of cell signal transduction pathways. This technology was designed specifically for ligand binding and immunological assays. Using this technology, fluorescent cells or beads at the bottom of the well are detected as localized areas of concentrated fluorescence using a data processing system. Unbound flurophore comprising the background signal is ignored, allowing for a wide variety of homogeneous assays. FMAT technology may be used for peptide ligand binding assays, immunofluorescence, apoptosis, cytotoxicity, and bead-based immunocapture assays. See, Miraglia S et. al., "Homogeneous cell and bead based assays for high throughput screening using flourometric microvolume assay technology," Journal of Biomolecular Screening; 4:193-204 (1999). In particular, FMAT technology may be used to test, confirm, and/or identify the ability of polypeptides (including polypeptide fragments and variants) to activate signal transduction pathways. For example, FMAT technology may be used to test, confirm, and/or identify the ability of polypeptides to upregulate production of immunomodulatory proteins (such as, for example, interleukins, GM-CSF, Rantes, and Tumor Necrosis factors, as well as other cellular regulators (e.g. insulin)).

Table 1E also describes the use of kinase assays for testing, demonstrating, or quantifying biological activity. In this regard, the phosphorylation and de-phosphorylation of specific amino acid residues (e.g. Tyrosine, Serine, Threonine) on cell-signal transduction proteins provides a fast, reversible means for activation and de-activation of cellular signal transduction pathways. Moreover, cell signal transduction via phosphorylation/de-phosphorylation is crucial to the regulation of a wide variety of cellular processes (e.g. proliferation, differentiation, migration, apoptosis, etc.). Accordingly, kinase assays provide a powerful tool useful for testing, confirming, and/or identifying polypeptides (including polypeptide fragments and variants) that mediate cell signal transduction events via protein phosphorylation. See e.g., Forrer, P., Tamaskovic R., and Jaussi, R. "Enzyme-Linked Immunosorbent Assay for Measurement of JNK, ERK, and p38 Kinase Activities" Biol. Chem. 379(8-9): 1101-1110 (1998).

Description of Table 1F

Polynucleotides encoding polypeptides of the present invention can be used in assays to test for one or more biological activities. One such biological activity which may be tested includes the ability of polynucleotides and polypeptides of the invention to stimulate up-regulation or down-regulation of expression of particular genes and proteins. Hence, if polynucleotides and polypeptides of the present invention exhibit activity in altering particular gene and protein expression patterns, it is likely that these polynucleotides and polypeptides of the present invention may be involved in, or capable of effecting changes in, diseases associated with the altered gene and protein expression profiles. Hence, polynucleotides, polypeptides, or antibodies of the present invention could be used to treat said associated diseases.

TAQMAN® assays may be performed to assess the ability of polynucleotides (and polypeptides they encode) to alter the expression pattern of particular "target" genes. TAQMAN® reactions are performed to evaluate the ability of a test agent to induce or repress expression of specific genes in different cell types. TAQMAN® gene expression quantification assays ("TAQMAN® assays") are well known to, and routinely performed by, those of ordinary skill in the art. TAQMAN® assays are performed in a two step reverse transcription/polymerase chain reaction (RT-PCR). In the first (RT) step, cDNA is reverse transcribed from total RNA samples using random hexamer primers. In the second (PCR) step, PCR products are synthesized from the cDNA using gene specific primers.

To quantify gene expression the TAQMAN® PCR reaction exploits the 5' nuclease activity of AMPLITAQ GOLD® DNA Polymerase to cleave a TAQMAN® probe (distinct from the primers) during PCR. The TAQMAN® probe contains a reporter dye at the 5'-end of the probe and a quencher dye at the 3', end of the probe. When the probe is intact, the proximity of the reporter dye to the quencher dye results in suppression of the reporter fluorescence. During PCR, if the target of interest is present, the probe specifically anneals between the forward and reverse primer sites. AMPLITAQ GOLD® DNA Polymerase then cleaves the probe between the reporter and quencher when the probe hybridizes to the target, resulting in increased fluorescence of the reporter (see FIG. 2). Accumulation of PCR products is detected directly by monitoring the increase in fluorescence of the reporter dye.

After the probe fragments are displaced from the target, polymerization of the strand continues. The 3'-end of the probe is blocked to prevent extension of the probe during PCR. This process occurs in every cycle and does not interfere with the exponential accumulation of product. The increase in fluorescence signal is detected only if the target sequence is complementary to the probe and is amplified during PCR. Because of these requirements, any nonspecific amplification is not detected.

For test sample preparation, vector controls or constructs containing the coding sequence for the gene of interest are transfected into cells, such as for example 293T cells, and supernatants collected after 48 hours. For cell treatment and RNA isolation, multiple primary human cells or human cell lines are used; such cells may include but are not limited to, Normal Human Dermal Fibroblasts, Aortic Smooth Muscle, Human Umbilical Vein Endothelial Cells, HepG2, Daudi, Jurkat, U937, Caco, and THP-1 cell lines. Cells are plated in growth media and growth is arrested by culturing without media change for 3 days, or by switching cells to low serum media and incubating overnight. Cells are treated for 1, 6, or 24 hours with either vector control supernatant or sample supernatant (or purified/partially purified protein preparations in buffer). Total RNA is isolated; for example, by using Trizol extraction or by using the Ambion RNAQUEOUS™-4PCR RNA isolation system. Expression levels of multiple genes are analyzed using TAQMAN®, and expression in the test sample is compared to control vector samples to identify genes induced or repressed. Each of the above described techniques are well known to, and routinely performed by, those of ordinary skill in the art.

Table 1F indicates particular disease classes and preferred indications for which polynucleotides, polypeptides, or antibodies of the present invention may be used in detecting, diagnosing, preventing, treating and/or ameliorating said diseases and disorders based on "target" gene expression patterns which may be up- or down-regulated by polynucleotides (and the encoded polypeptides) corresponding to each indicated cDNA Clone ID (shown in Table 1F, Column 2).

Thus, in preferred embodiments, the present invention encompasses a method of detecting, diagnosing, preventing, treating, and/or ameliorating a disease or disorder listed in the "Disease Class" and/or "Preferred Indication" columns of Table 1F; comprising administering to a patient in which such detection, diagnosis, prevention, or treatment is desired a protein, nucleic acid, or antibody of the invention (or fragment or variant thereof) in an amount effective to detect, diagnose, prevent, treat, or ameliorate the disease or disorder. The first and second columns of Table 1D show the "Gene No." and "cDNA Clone ID No.", respectively, indicating certain nucleic acids and proteins (or antibodies against the same) of the invention (including polynucleotide, polypeptide, and antibody fragments or variants thereof) that may be used in detecting, diagnosing, preventing, treating, or ameliorating the disease(s) or disorder(s) indicated in the corresponding row in the "Disease Class" or "Preferred Indication" Columns of Table 1F.

In another embodiment, the present invention also encompasses methods of detecting, diagnosing, preventing, treating, or ameliorating a disease or disorder listed in the "Disease Class" or "Preferred Indication" Columns of Table 1; comprising administering to a patient combinations of the proteins, nucleic acids, or antibodies of the invention (or fragments or variants thereof), sharing similar indications as shown in the corresponding rows in the "Disease Class" or "Preferred Indication" Columns of Table 1F.

The "Disease Class" Column of Table 1F provides a categorized descriptive heading for diseases, disorders, and/or conditions (more fully described below) that may be detected, diagnosed, prevented, treated, or ameliorated by a protein, nucleic acid, or antibody of the invention (or fragment or variant thereof).

The "Preferred Indication" Column of Table 1F describes diseases, disorders, and/or conditions that may be detected, diagnosed, prevented, treated, or ameliorated by a protein, nucleic acid, or antibody of the invention (or fragment or variant thereof).

The "Cell Line" and "Exemplary Targets" Columns of Table 1F indicate particular cell lines and target genes, respectively, which may show altered gene expression patterns (i.e., up- or down-regulation of the indicated target gene) in TAQMAN® assays, performed as described above, utilizing polynucleotides of the cDNA Clone ID shown in the corresponding row. Alteration of expression patterns of the indicated "Exemplary Target" genes is correlated with a particular "Disease Class" and/or "Preferred Indication" as shown in the corresponding row under the respective column headings.

The "Exemplary Accessions" Column indicates GenBank Accessions (available online through the National Center for Biotechnology Information (NCBI) at www.ncbi.nim.nih.gov/) which correspond to the "Exemplary Targets" shown in the adjacent row.

The recitation of "Cancer" in the "Disease Class" Column indicates that the corresponding nucleic acid and protein, or antibody against the same, of the invention (or fragment or variant thereof) may be used for example, to detect, diagnose, prevent, treat, and/or ameliorate neoplastic diseases and/or disorders (e.g., leukemias, cancers, etc., as described below under "Hyperproliferative Disorders").

The recitation of "Immune" in the "Disease Class" column indicates that the corresponding nucleic acid and protein, or antibody against the same, of the invention (or fragment or variant thereof), may be used for example, to detect, diagnose, prevent, treat, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

The recitation of "Angiogenesis" in the "Disease Class" column indicates that the corresponding nucleic acid and protein, or antibody against the same, of the invention (or fragment or variant thereof), may be used for example, to detect, diagnose, treat, prevent, and/or ameliorate diseases and/or disorders relating to neoplastic diseases (e.g., as described below under "Hyperproliferative Disorders"), diseases and/or disorders of the cardiovascular system (e.g., as described below under "Cardiovascular Disorders"), diseases and/or disorders involving cellular and genetic abnormalities (e.g., as described below under "Diseases at the Cellular Level"), diseases and/or disorders involving angiogenesis (e.g., as described below under "Anti-Angiogenesis Activity"), to promote or inhibit cell or tissue regeneration (e.g., as described below under "Regeneration"), or to promote wound healing (e.g., as described below under "Wound Healing and Epithelial Cell Proliferation").

The recitation of "Diabetes" in the "Disease Class" column indicates that the corresponding nucleic acid and protein, or antibody against the same, of the invention (or fragment or variant thereof), may be used for example, to detect, diagnose, treat, prevent, and/or ameliorate diabetes (including diabetes mellitus types I and II), as well as diseases and/or disorders associated with, or consequential to, diabetes (e.g. as described below under "Endocrine Disorders," "Renal Disorders," and "Gastrointestinal Disorders").

Description of Table 1F

Polynucleotides encoding polypeptides of the present invention can be used in assays to test for one or more biological activities. One such biological activity which may be tested includes the ability of polynucleotides and polypeptides of the invention to stimulate up-regulation or down-regulation of expression of particular genes and proteins. Hence, if polynucleotides and polypeptides of the present invention exhibit activity in altering particular gene and protein expression patterns, it is likely that these polynucleotides and polypeptides of the present invention may be involved in, or capable of effecting changes in, diseases associated with the altered gene and protein expression profiles. Hence, polynucleotides, polypeptides, or antibodies of the present invention could be used to treat said associated diseases.

TAQMAN® assays may be performed to assess the ability of polynucleotides (and polypeptides they encode) to alter the expression pattern of particular "target" genes. TAQMAN® reactions are performed to evaluate the ability of a test agent to induce or repress expression of specific genes in different cell types. TAQMAN® gene expression quantification assays ("TAQMAN® assays") are well known to, and routinely performed by, those of ordinary skill in the art. TAQMAN® assays are performed in a two step reverse transcription/polymerase chain reaction (RT-PCR). In the first (RT) step, cDNA is reverse transcribed from total RNA samples using random hexamer primers. In the second (PCR) step, PCR products are synthesized from the cDNA using gene specific primers.

To quantify gene expression the TAQMAN® PCR reaction exploits the 5' nuclease activity of AMPLITAQ GOLD® DNA Polymerase to cleave a TAQMAN® probe (distinct from the primers) during PCR. The TAQMAN® probe contains a reporter dye at the 5'-end of the probe and a quencher dye at the 3', end of the probe. When the probe is intact, the proximity of the reporter dye to the quencher dye results in suppression of the reporter fluorescence. During PCR, if the target of interest is present, the probe specifically anneals between the forward and reverse primer sites. AMPLITAQ GOLD® DNA Polymerase then cleaves the probe between the reporter and quencher when the probe hybridizes to the target, resulting in increased fluorescence of the reporter (see FIG. 2). Accumulation of PCR products is detected directly by monitoring the increase in fluorescence of the reporter dye.

After the probe fragments are displaced from the target, polymerization of the strand continues. The 3'-end of the probe is blocked to prevent extension of the probe during PCR. This process occurs in every cycle and does not interfere with the exponential accumulation of product. The increase in fluorescence signal is detected only if the target sequence is complementary to the probe and is amplified during PCR. Because of these requirements, any nonspecific amplification is not detected.

For test sample preparation, vector controls or constructs containing the coding sequence for the gene of interest are transfected into cells, such as for example 293T cells, and supernatants collected after 48 hours. For cell treatment and RNA isolation, multiple primary human cells or human cell lines are used; such cells may include but are not limited to, Normal Human Dermal Fibroblasts, Aortic Smooth Muscle, Human Umbilical Vein Endothelial Cells, HepG2, Daudi, Jurkat, U937, Caco, and THP-1 cell lines. Cells are plated in growth media and growth is arrested by culturing without media change for 3 days, or by switching cells to low serum media and incubating overnight. Cells are treated for 1, 6, or 24 hours with either vector control supernatant or sample supernatant (or purified/partially purified protein preparations in buffer). Total RNA is isolated; for example, by using Trizol extraction or by using the Ambion RNAQUEOUS™-4PCR RNA isolation system. Expression levels of multiple genes are analyzed using TAQMAN®, and expression in the test sample is compared to control vector samples to identify genes induced or repressed. Each of the above described techniques are well known to, and routinely performed by, those of ordinary skill in the art.

Table 1F indicates particular disease classes and preferred indications for which polynucleotides, polypeptides, or antibodies of the present invention may be used in detecting, diagnosing, preventing, treating and/or ameliorating said diseases and disorders based on "target" gene expression patterns which may be up- or down-regulated by polynucleotides (and the encoded polypeptides) corresponding to each indicated cDNA Clone ID (shown in Table 1F, Column 2).

Thus, in preferred embodiments, the present invention encompasses a method of detecting, diagnosing, preventing, treating, and/or ameliorating a disease or disorder listed in the "Disease Class" and/or "Preferred Indication" columns of Table 1F; comprising administering to a patient in which such detection, diagnosis, prevention, or treatment is desired a protein, nucleic acid, or antibody of the invention (or fragment or variant thereof) in an amount effective to detect, diagnose, prevent, treat, or ameliorate the disease or disorder. The first and second columns of Table 1D show the "Gene No." and "cDNA Clone ID No.", respectively, indicating certain nucleic acids and proteins (or antibodies against the same) of the invention (including polynucleotide, polypeptide, and antibody fragments or variants thereof) that may be used in detecting, diagnosing, preventing, treating, or ameliorating the disease(s) or disorder(s) indicated in the corresponding row in the "Disease Class" or "Preferred Indication" Columns of Table 1F.

In another embodiment, the present invention also encompasses methods of detecting, diagnosing, preventing, treating, or ameliorating a disease or disorder listed in the "Disease Class" or "Preferred Indication" Columns of Table 1; comprising administering to a patient combinations of the proteins, nucleic acids, or antibodies of the invention (or fragments or variants thereof), sharing similar indications as shown in the corresponding rows in the "Disease Class" or "Preferred Indication" Columns of Table 1F.

The "Disease Class" Column of Table 1F provides a categorized descriptive heading for diseases, disorders, and/or conditions (more fully described below) that may be detected, diagnosed, prevented, treated, or ameliorated by a protein, nucleic acid, or antibody of the invention (or fragment or variant thereof).

The "Preferred Indication" Column of Table 1F describes diseases, disorders, and/or conditions that may be detected, diagnosed, prevented, treated, or ameliorated by a protein, nucleic acid, or antibody of the invention (or fragment or variant thereof).

The "Cell Line" and "Exemplary Targets" Columns of Table 1F indicate particular cell lines and target genes, respectively, which may show altered gene expression patterns (i.e., up- or down-regulation of the indicated target gene) in TAQMAN® assays, performed as described above, utilizing polynucleotides of the cDNA Clone ID shown in the corresponding row. Alteration of expression patterns of the indicated "Exemplary Target" genes is correlated with a particular "Disease Class" and/or "Preferred Indication" as shown in the corresponding row under the respective column headings.

The "Exemplary Accessions" Column indicates GenBank Accessions (available online through the National Center for Biotechnology Information (NCBI) at www.ncbi.nim.nih.gov/) which correspond to the "Exemplary Targets" shown in the adjacent row.

The recitation of "Cancer" in the "Disease Class" Column indicates that the corresponding nucleic acid and protein, or antibody against the same, of the invention (or fragment or variant thereof) may be used for example, to detect, diagnose, prevent, treat, and/or ameliorate neoplastic diseases and/or disorders (e.g., leukemias, cancers, etc., as described below under "Hyperproliferative Disorders").

The recitation of "Immune" in the "Disease Class" column indicates that the corresponding nucleic acid and protein, or antibody against the same, of the invention (or fragment or variant thereof), may be used for example, to detect, diagnose, prevent, treat, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

The recitation of "Angiogenesis" in the "Disease Class" column indicates that the corresponding nucleic acid and protein, or antibody against the same, of the invention (or fragment or variant thereof), may be used for example, to detect, diagnose, treat, prevent, and/or ameliorate diseases and/or disorders relating to neoplastic diseases (e.g., as described below under "Hyperproliferative Disorders"), diseases and/or disorders of the cardiovascular system (e.g., as described below under "Cardiovascular Disorders"), diseases and/or disorders involving cellular and genetic abnormalities (e.g., as described below under "Diseases at the Cellular Level"), diseases and/or disorders involving angiogenesis (e.g., as described below under "Anti-Angiogenesis Activity"), to promote or inhibit cell or tissue regeneration (e.g., as described below under "Regeneration"), or to promote wound healing (e.g., as described below under "Wound Healing and Epithelial Cell Proliferation").

The recitation of "Diabetes" in the "Disease Class" column indicates that the corresponding nucleic acid and protein, or antibody against the same, of the invention (or fragment or variant thereof), may be used for example, to detect, diagnose, treat, prevent, and/or ameliorate diabetes (including diabetes mellitus types I and II), as well as diseases and/or disorders associated with, or consequential to, diabetes (e.g. as described below under "Endocrine Disorders," "Renal Disorders," and "Gastrointestinal Disorders").

Description of Table 2

Table 2 summarizes homology and features of some of the polypeptides of the invention. The first column provides a unique clone identifier, "Clone ID:", corresponding to a cDNA clone disclosed in Table 1A or 1B. The second column provides the unique contig identifier, "Contig ID:" corresponding to contigs in Table 1B and allowing for correlation with the information in Table 1B. The third column provides the sequence identifier, "SEQ ID NO:X", for the contig polynucleotide sequence. The fourth column provides the analysis method by which the homology/identity disclosed in the Table was determined. Comparisons were made between polypeptides encoded by the polynucleotides of the invention and either a non-redundant protein database (herein referred to as "NR"), or database of protein families (herein referred to as "PFAM") as further described below. The fifth column provides a description of the PFAM/NR hit having a significant match to a polypeptide of the invention. Column six provides the accession number of the PFAM/NR hit disclosed in the fifth column. Column seven, "Score/Percent Identity" provides a quality score or the percent identity, of the hit disclosed in columns five and six. Columns 8 and 9, "NT From" and "NT To" respectively, delineate the polynucleotides in "SEQ ID NO:X" that encode a polypeptide having a significant match to the PFAM/NR database as disclosed in the fifth and sixth columns. In specific embodiments polypeptides of the invention comprise, or alternatively consist of, an amino acid sequence encoded by a polynucleotide in SEQ ID NO:X as delineated in columns 8 and 9, or fragments or variants thereof.

Description of Table 3

Table 3 provides polynucleotide sequences that may be disclaimed according to certain embodiments of the invention. The first column provides a unique clone identifier, "Clone ID", for a cDNA clone related to contig sequences disclosed in Table 1B. The second column provides the sequence identifier, "SEQ ID NO:X", for contig sequences disclosed in Table 1A and/or 1B. The third column provides the unique contig identifier, "Contig ID:", for contigs disclosed in Table 1B. The fourth column provides a unique integer 'a' where 'a' is any integer between 1 and the final nucleotide minus 15 of SEQ ID NO:X, and the fifth column provides a unique integer 'b' where 'b' is any integer between 15 and the final nucleotide of SEQ ID NO:X, where both a and b correspond to the positions of nucleotide residues shown in SEQ ID NO:X, and where b is greater than or equal to a 4. For each of the polynucleotides shown as SEQ ID NO:X, the uniquely defined integers can be substituted into the general formula of a-b, and used to describe polynucleotides which may be preferably excluded from the invention. In certain embodiments, preferably excluded from the invention are at least one, two, three, four, five, ten, or more of the polynucleotide sequence(s) having the accession number(s) disclosed in the sixth column of this Table (including for example, published sequence in connection with a particular BAC clone). In further embodiments, preferably excluded from the invention are the specific polynucleotide sequence(s) contained in the clones corresponding to at least one, two, three, four, five, ten, or more of the available material having the accession numbers identified in the sixth column of this Table (including for example, the actual sequence contained in an identified BAC clone).

Description of Table 4

Table 4 provides a key to the tissue/cell source identifier code disclosed in Table 1B.2, column 5. Column 1 provides the tissue/cell source identifier code disclosed in Table 1B.2, Column 5. Columns 2-5 provide a description of the tissue or cell source. Note that "Description" and "Tissue" sources (i.e. columns 2 and 3) having the prefix "a_" indicates organs, tissues, or cells derived from "adult" sources. Codes corresponding to diseased tissues are indicated in column 6 with the word "disease." The use of the word "disease" in column 6 is non-limiting. The tissue or cell source may be specific (e.g. a neoplasm), or may be disease-associated (e.g., a tissue sample from a normal portion of a diseased organ). Furthermore, tissues and/or cells lacking the "disease" designation may still be derived from sources directly or indirectly involved in a disease state or disorder, and therefore may have a further utility in that disease state or disorder. In numerous cases where the tissue/cell source is a library, column 7 identifies the vector used to generate the library.

Description of Table 5

Table 5 provides a key to the OMIM reference identification numbers disclosed in Table 1B.1, column 9. OMIM reference identification numbers (Table 5, Column 1) were derived from Online Mendelian Inheritance in Man (Online Mendelian Inheritance in Man, OMIM. McKusick-Nathans Institute for Genetic Medicine, Johns Hopkins University (Baltimore, Md.) and National Center for Biotechnology Information, National Library of Medicine, (Bethesda, Md.) 2000. World Wide Web URL: http://www.ncb.nim.nih.gov/omim/). Column 2 provides diseases associated with the cytologic band disposed in Table 1B.1, column 8, as determined using the Morbid Map database.

Description of Table 6

Table 6 summarizes some of the ATCC™ Deposits, Deposit dates, and ATCC™ designation numbers of deposits made with the ATCC™ in connection with the present application. These deposits were made in addition to those described in the Table 1A.

Description of Table 7

Table 7 shows the cDNA libraries sequenced, and ATCC™ designation numbers and vector information relating to these cDNA libraries.

The first column shows the first four letters indicating the Library from which each library clone was derived. The second column indicates the catalogued tissue description for the corresponding libraries. The third column indicates the vector containing the corresponding clones. The fourth column shows the ATCC™ deposit designation for each library clone as indicated by the deposit information in Table 6.

Definitions

The following definitions are provided to facilitate understanding of certain terms used throughout this specification.

In the present invention, "isolated" refers to material removed from its original environment (e.g., the natural environment if it is naturally occurring), and thus is altered "by the hand of man" from its natural state. For example, an isolated polynucleotide could be part of a vector or a composition of matter, or could be contained within a cell, and still be "isolated" because that vector, composition of matter, or particular cell is not the original environment of the polynucleotide. The term "isolated" does not refer to genomic or cDNA libraries, whole cell total or mRNA preparations, genomic DNA preparations (including those separated by electrophoresis and transferred onto blots), sheared whole cell genomic DNA preparations or other compositions where the art demonstrates no distinguishing features of the polynucleotide/sequences of the present invention.

In the present invention, a "secreted" protein refers to those proteins capable of being directed to the ER, secretory, vesicles, or the extracellular space as a result of a signal sequence as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage.

As used herein, a "polynucleotide" refers to a molecule having a nucleic acid sequence encoding SEQ ID NO:Y or a fragment or variant thereof (e.g., the polypeptide delineated in columns fourteen and fifteen of Table 1A); a nucleic acid sequence contained in SEQ ID NO:X (as described in column 5 of Table 1A and/or column 3 of Table 1B) or the complement thereof; a cDNA sequence contained in Clone ID: (as described in column 2 of Table 1A and/or 1B and contained within a library deposited with the ATCC™); a nucleotide sequence encoding the polypeptide encoded by a nucleotide sequence in SEQ ID NO:B as defined in column 6 (EXON From-To) of Table 1C or a fragment or variant thereof; or a nucleotide coding sequence in SEQ ID NO:B as defined in column 6 of Table 1C or the complement thereof. For example, the polynucleotide can contain the nucleotide sequence of the full length cDNA sequence, including the 5' and 3' untranslated sequences, the coding region, as well as fragments, epitopes, domains, and variants of the nucleic acid sequence. Moreover, as used herein, a "polypeptide" refers to a molecule having an amino acid sequence encoded by a polynucleotide of the invention as broadly defined (obviously excluding poly-phenylalanine or poly-Lysine peptide sequences which result from translation of a polyA tail of a sequence corresponding to a cDNA).

In the present invention, "SEQ ID NO:X" was often generated by overlapping sequences contained in multiple clones (contig analysis). A representative clone containing all or most of the sequence for SEQ ID NO:X is deposited at Human Genome Sciences, Inc. (HGS) in a catalogued and archived library. As shown, for example, in column 2 of Table 1B, each clone is identified by a cDNA Clone ID (identifier generally referred to herein as Clone ID:). Each Clone ID is unique to an individual clone and the Clone ID is all the information needed to retrieve a given clone from the HGS library. Table 7 provides a list of the deposited cDNA libraries. One can use the Clone ID: to determine the library source by reference to Tables 6 and 7. Table 7 lists the deposited cDNA libraries by name and links each library to an ATCC™ Deposit. Library names contain four characters, for example, "HTWE." The name of a cDNA clone (Clone ID) isolated from that begins with the same four characters, for example "HTWEP07". As mentioned below, Table 1A and/or 1B correlates the Clone ID names with SEQ ID NO:X. Thus, staring with an SEQ ID NO:X, one can use Tables 1A, 1B, 6, 7, and 9 to determine the corresponding Clone ID, which library it came from and which ATCC™ deposit the library is contained in. Furthermore, it is possible to retrieve a given cDNA clone from the source library by techniques known in the art and described elsewhere herein. The ATCC™ is located at 10801 University Boulevard, Manassas, Va. 20110-2209, USA. The ATCC™ deposits were made pursuant to the terms of the Budapest Treaty on the international recognition of the deposit of microorganisms for the purposes of patent procedure.

In specific embodiments, the polynucleotides of the invention are at least 15, at least 30, at least 50, at least 100, at least 125, at least 500, or at least 1000 continuous nucleotides but are less than or equal to 300 kb, 200 kb, 100 kb, 50 kb, 15 kb, 10 kb, 7.5 kb, 5 kb, 2.5 kb, 2.0 kb, or 1 kb, in length. In a further embodiment, polynucleotides of the invention comprise a portion of the coding sequences, as disclosed herein, but do not comprise all or a portion of any intron. In another embodiment, the polynucleotides comprising coding sequences do not contain coding sequences of a genomic flanking gene (i.e., 5' or 3' to the gene of interest in the genome). In other embodiments, the polynucleotide of the invention do not contain the coding sequence of more than 1000, 500, 250, 100, 50, 25, 20, 15, 10, 5, 4, 3, 2, or 1 genomic flanking gene(s).

A "polynucleotide" of the present invention also includes those polynucleotides capable of hybridizing, under stringent hybridization conditions, to sequences contained in SEQ ID NO:X, pr the complement thereof (e.g., the complement of any one, two, three, four, or more of the polynucleotide fragments described herein), the polynucleotide sequence delineated in columns 7 and 8 of Table 1A or the complement thereof, the polynucleotide sequence delineated in columns 8 and 9 of Table 2 or the complement thereof, and/or cDNA sequences contained in Clone ID: (e.g., the complement of any one, two, three, four or more of the polynucleotide fragments, or the cDNA clone within the pool of cDNA clones deposited with the ATCC™, described herein), and/or the polynucleotide sequence delineated in column 6 of Table 1C or the complement thereof. "Stringent hybridization conditions" refers to an overnight incubation at 42 degree C. in a solution comprising 50% formamide, 5×SSC (750 mM NaCl, 75 mM trisodium citrate), 50 mM sodium phosphate (pH 7.6), 5× Denhardt's solution, 10% dextran sulfate, and 20 µg/ml denatured sheared salmon sperm DNA, followed by washing the filters in 0.1×SSC at about 65 degree C.

Also contemplated are nucleic acid molecules that hybridize to the polynucleotides of the present invention at lower stringency hybridization conditions. Changes in the stringency of hybridization and signal detection are primarily accomplished through the manipulation of formamide concentration (lower percentages of formamide result in lowered stringency) salt conditions, or temperature. For example, lower stringency conditions include an overnight incubation at 37 degree C. in a solution comprising 6×SSPE (20× SSPE=3M NaCl, 0.2M $NaH_2PO_4$; 0.02M EDTA, pH 7.4), 0.5% SDS, 30% formamide, 100 ug/ml salmon sampan sperm blocking DNA; followed by washes at 50 degree C. with 1×SSPE, 0.1% SDS. In addition, to achieve even lower stringency, washes performed following stringent hybridization can be done at higher salt concentrations (e.g. 5×SSC).

Note that variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

Of course, a polynucleotide which hybridizes only to polyA+ sequences (such as any 3' terminal polyA+ tract of a cDNA shown in the sequence listing), or to a complementary stretch of T (or U) residues, would not be included in the definition of "polynucleotide" since such polynucleotide would hybridize to any nucleic acid molecule containing a poly (A) stretch or the complement thereof (e.g., practically any double-stranded cDNA clone generated using oligo dT as a primer).

The polynucleotide of the present invention can be composed of any polyribonucleotide or polydeoxribonucleotide, which may be unmodified RNA or DNA or modified RNA pr DNA. For example, polynucleotides can be composed of single- and double-stranded DNA. DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, the polynucleotide can be composed of triple-stranded regions comprising RNA or DNA or both RNA and DNA. A polynucleotide may also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

In specific embodiments, the polynucleotides of the invention are at least 15, at least 30, at least 50, at least 100, at least 125, at least 500, or at least 1000 continuous nucleotides but are less than or equal to 300 kb, 200 kb, 100 kb, 50 kb, 15 kb, 10 kb, 7.5 kb, 5 kb, 2.5 kb, 2.0 kb, or 1 kb, in length. In a further embodiment, polynucleotides of the invention comprise a portion of the coding sequences, as disclosed herein, but do not comprise all or a portion of any intron. In another embodiment, the polynucleotides comprising coding sequences do not contain coding sequences of a genomic flanking gene (i.e. 5' or 3' to the gene of invention in the genome). In other embodiments, the polynucleotides of the invention do not contain the coding sequence of more than 1000, 500, 250, 100, 50, 25, 20, 15, 10, 5, 4, 3, 2, or 1 genomic flanking gene(s).

"SEQ ID NO:X" refers to a polynucleotide sequence described in column 5 of Table 1A, while "SEQ ID NO:Y" refers to a polypeptide sequence described in column 10 of Table 1A SEQ ID NO:X is identified by an integer specified in column 6 of Table 1A. The polypeptide sequence SEQ ID NO:Y is a translated open reading frame (ORF) encoded by polypeptide sequence SEQ ID NO:X. The polynucleotide sequences are shown in the sequence listing immediately followed by all of the polypeptide sequences. Thus, a polypeptide sequence corresponding to polynucleotide sequence SEQ ID NO:2 is the first polypeptide sequence shown in the sequence listing. The second polypeptide sequence corresponds to the polynucleotide sequence shown as SEQ ID NO:3, and so on.

The polypeptide of the present invention can be composed of amino acids joined to each other by peptide of the bonds or modified peptide bonds, i.e., peptide isosteres, and may contain amino acids other than the 20 gene-encoded amino acids. The polypeptides may be modified by either natural processes, such as posttranslational processing, or by chemical modification techniques which are well known in the art. Such modifications are well described in basic texts and in more detailed monographs, as well as in a voluminous research literature. Modifications can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cystine, formation, of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W.H. Freeman and Company, New York (1993); POSTTRANSLATIONAL COVALENT MODIFICATION OF PROTEINS, B. C. Johnson, Ed., Academic Press, New York, pgs. 1-12 (1993), Seifter et al., Meth. Enzymol. 182: 626-646 (1990); Rattan et al., Ann. N.Y. Acad. Sci. 663:48-62 (1992)).

"SEQ ID NO:X" refers to a polynucleotide sequence described, for example, in Tables 1A, 1B or 2, while "SEQ ID NO:Y" refers to a polypeptide sequence described in column 11 of Table 1A and/or column 6 of Table 1B.1. SEQ ID NO:X is identified by an integer specified in column 4 of Table 1B.1. The polypeptide sequence SEQ ID NO:Y is a translated open reading frame (ORF) encoded by polynucleotide SEQ ID NO:X. "Clone ID:" refers to a cDNA clone described in column 2 of Table 1A and/or 1B.

"A polypeptide having functional activity" refers to a polypeptide capable of displaying one or more known functional activities associated with a full-length (complete) protein. Such functional activities include, but are not limited to, biological activity, antigenicity [ability to bind (or compete with a polypeptide for binding) to an anti-polypeptide antibody], immunogenicity (ability to generate antibody which binds to a specific polypeptide of the invention), ability to form multimers with polypeptides of the invention, and ability to bind to a receptor or ligand for a polypeptide.

The polypeptide of the invention can be assayed for functional activity (e.g. biological activity) using or routinely modifying assays known in the art, as well as assays described herein. Specifically, one of skill in the art may routinely assay secreted polypeptides (including fragments and variants) of the invention for activity using assays as described in the examples section below.

"A polypeptide having biological activity" refers to a polypeptide exhibiting activity similar to, but not necessarily identical to, an activity of a polypeptide of the present invention, including mature forms, as measured in a particular biological assay, with or without dose dependency. In the case where dose dependency does exist, it need not be identical to that of the polypeptide, but rather substantially similar to the dose-dependence in a given activity as compared to the polypeptide of the present invention (i.e., the candidate polypeptide will exhibit greater activity or not more than about 25-fold less and, preferably, not more than about ten-fold less activity, and most preferably, not more than about three-fold less activity relative to the polypeptide of the present invention).

Tables

Table 1A

Table 1A summarizes information concerning certain polynucleotides and polypeptides of the invention. The first column provides the gene number in the application for each clone identifier. The second column provides a unique clone identifier, "Clone ID:", for a cDNA clone related to each contig sequence disclosed in Table 1A. Third column, the cDNA Clones identified in the second column were deposited as indicated in the third column (i.e. by ATCC™ Deposit No:Z and deposit date). Some of the deposits contain multiple different clones corresponding to the same gene. In the fourth column, "Vector" refers to the type of vector contained in the corresponding cDNA Clone identified in the second column. In the fifth column, the nucleotide sequence identified as "NT SEQ ID NO:X" was assembled from partially homologous ("overlapping") sequences obtained from the corresponding cDNA clone identified in the second column and, in some cases, from additional related cDNA clones. The overlapping sequences were assembled into a single contiguous sequence of high redundancy (usually three to five overlapping sequences at each nucleotide position), resulting in a final sequence identified as SEQ ID NO:X. In the sixth column, "Total NT Seq." refers to the total number of nucleotides in the contig sequence identified as SEQ ID NO:X." The deposited clone may contain all or most of these sequences, reflected by the nucleotide position indicated as "5' NT of Clone Seq." (seventh column) and the "3' NT of Clone Seq." (eighth column) of SEQ ID NO:X. In the ninth column, the nucleotide position of SEQ ID NO:X of the putative start codon (methionine) is identified as "5' NT of Start Codon." Similarly, in column ten, the nucleotide position of SEQ ID NO:X of the predicted signal sequence is identified as "5' NT of First AA of Signal Pep." In the eleventh column the translated amino acid sequence, beginning with the methionine, is identified as "AA SEQ ID NO:Y," although other reading frames can also be routinely translated using known molecular biology techniques. The polypeptides produced by these alternative open reading frames are specifically contemplated by the present invention.

In the twelfth and thirteenth columns of Table 1A, the first and last amino acid position of SEQ ID NO:Y of the predicted signal peptide is identified as "First AA of Sig Pep" and "Last AA of Sig Pep." In the fourteenth column, the predicted first amino acid position of SEQ ID NO:Y of the secreted portion is identified as "Predicted First AA of Secreted Portion." The amino acid position of SEQ ID NO:Y of the last amino acid encoded by the open reading frame is identified in the fifteenth column as "Last AA of ORF".

SEQ ID NO:X (where X may be any of the polynucleotide sequences disclosed in the sequence listing) and the translated SEQ ID NO:Y (where Y may be any of the polypeptide sequences disclosed in the sequence listing) are sufficiently accurate and otherwise suitable for a variety of uses well known in the art and described further below. For instance, SEQ IS NO:X is useful for designing nucleic acid hybridization probes that will detect nucleic acid sequences contained in SEQ ID NO:X or the cDNA contained in the deposited clone. These probes will also hybridize to nucleic acid molecules in biological samples thereby enabling a variety of forensic and diagnostic methods of the invention. Similarly, polypeptides identified from SEQ ID NO:Y may be used, for example, to generate antibodies which bind specifically to proteins containing the polypeptides and the secreted proteins encoded by the cDNA clones identified in Table 1A and/or elsewhere herein.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequence identified as SEQ ID NO:X, and a predicted translated amino acid sequence identified as SEQ ID NO:Y, but also a sample of plasmid DNA containing a human cDNA of the invention deposited with the ATCC™, as set forth in Table 1A. The nucleotide sequence of each deposited plasma can readily be determined by sequencing the deposited plasmid in accordance with known methods.

The predicted amino acid sequence can then be verified from such deposits. Moreover, the amino acid sequence of the protein encoded by a particular clone can also be directly determined by peptide sequencing or by expressing the protein in a suitable host cell containing the deposited human cDNA, collecting the protein, and determining its sequence.

Also provided in Table 1A is the name of the vector which contains the cDNA plasmid. Each vector is routinely used in the art. The following additional information is provided for convenience.

Vectors Lambda Zap (U.S. Pat. Nos. 5,128,256 and 5,286, 636), Uni-Zap XR (U.S. Pat. Nos. 5,128,256 and 5,286,636), Zap Express (U.S. Pat. Nos. 5,128,256 and 5,286,636), pBluescript (pBS) (Short, J. M. et al., *Nucleic Acids Res.* 16:7583-7600 (1988); Alting-Mees, M. A. and Short, J. M., *Nucleic Acids Res.* 17:9494 (1989)) and pBK (Alting-Mees, M. A. et al., *Strategies* 5:58-61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Phagemid pBS may be excised from the Lambda Zap and Uni-Zap XR vectors, and phagemid pBK may be excised from the Zap Express vector. Both phagemids may be transformed into *E. coli* strain XL-1 Blue, also available from Stratagene.

Vectors pSport1, pCMVSport 1.0, pCMVSport 2.0 and pCMVSport 3.0, were, obtained from Life Technologies, Inc., P.O. Box 6009, Gaithersburg, Md. 20897. All Sport vectors contain an ampicillin resistance gene and may be transformed into *E. coli* strain DH10B, also available from Life Technologies. See, for instance, Gruber, C. E., et al., *Focus* 15:59 (1993). Vector lafmid BA (Bento Soares, Columbia University, New York, N.Y.) contains an ampicillin resistance gene and can be transformed into *E. coli* strain XL-1 Blue. Vector pCR®2.1, which is available from Invitrogen, 1600 Faraday Avenue, Carlsbad, Calif. 92008, contains an ampicillin resistance gene and may be transformed into *E coli* strain DH10B, available from Life Technologies. See, for instance, Clark, J. M., *Nuc. Acids Res.* 16:9677-9686 (1988) and Mead, D. et al., *Bio/Technology* 9. (1991).

The present invention also relates to the genes corresponding to SEQ ID NO:X, SEQ ID NO:Y, and/or a deposited cDNA (cDNA Clone ID). The corresponding gene can be isolated in accordance with known methods using the sequence information disclosed herein. Such methods include, but are not limited to, preparing probes or primers from the disclosed sequence and identifying or amplifying the corresponding gene from appropriate sources of genomic material.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to SEQ ID NO:X and SEQ ID NO:Y using information from the sequences disclosed herein or the clones deposited with the ATCC™. For example, allelic variants and/or species homologs may be isolated and identified by making suitable probes or primers from the sequences provided herein and screening a suitable nucleic acid source for allelic variants and/or the desired homologue.

The present invention provides a polynucleotide comprising, or alternatively consisting of, the nucleic acid sequence of SEQ ID NO:X and/or a cDNA contained in ATCC™ Deposit No.Z. The present invention also provides a polypeptide comprising, or alternatively, consisting of, the polypeptide sequence of SEQ ID NO:Y, a polypeptide encoded by SEQ ID NO:X, and/or a polypeptide encoded by a cDNA contained in ATCC™ deposit No.Z. Polynucleotides encoding a polypeptide comprising, or alternatively consisting of the polypeptide sequence of SEQ ID NO:Y, a polypeptide encoded by SEQ ID NO:X and/or a polypeptide encoded by the cDNA contained in ATCC™ Deposit No.Z are also encompassed by the invention. The present invention further encompasses a polynucleotide comprising, or alternatively consisting of the complement of the nucleic acid sequence of SEQ ID NO:X, and/or the complement of the coding strand of the cDNA contained in ATCC™ Deposit No.Z.

Lengthy table referenced here

US07411051-20080812-T00001

Please refer to the end of the specification for access instructions.

Table 1B (Comprised of Tables 1B.1 and 1B.2)

The first column in Table 1B.1 and Table 1B.2 provides the gene number in the application corresponding to the clone identifier. The second column in Table 1B.1 and Table 1B.2 provides a unique "Clone ID:" for the cDNA clone related to each contig sequence disclosed in Table 1B.1 and Table 1B.2. This clone ID references the cDNA clone which contains at least the 5' most sequence of the assembled contig and at least a portion of SEQ ID NO:X as determined by directly sequencing the referenced clone. The referenced clone may have more sequence than described in the sequence listing or the clone may have less. In the vast majority of cases, however, the clone is believed to encode a full-length polypeptide. In the case where a clone is not full-length, a full-length cDNA can be obtained by methods described elsewhere herein. The third column in Table 1B.1 and Table 1B.2 provides a unique "Contig ID" identification for each contig sequence. The fourth column in Table 1B.1 and Table 1B.2 provides the "SEQ ID NO:" identifier for each of the contig polynucleotide sequences disclosed in Table 1B.

Table 1B.1

The fifth column in Table 1B.1, "ORF (From-To)", provides the location (i.e., nucleotide position numbers) within the polynucleotide sequence "SEQ ID NO:X" that delineate the preferred open reading frame (ORF) shown in the sequence listing and referenced in Table 1B.1, column 6, as SEQ ID NO:Y. Where the nucleotide position number "To" is lower than the nucleotide position number "From", the preferred ORF is the reverse complement of the referenced polynucleotide sequence. The sixth column in Table 1B.1 provides the corresponding SEQ ID NO:Y for the polypeptide sequence encoded by the preferred ORF delineated in column 5. In one embodiment, the invention provides an amino acid sequence comprising, or alternatively consisting of, a polypeptide encoded by the portion of SEQ ID NO:X delineated by "ORF (From-To)". Also provided are polynucleotides encoding such amino acid sequences and the complementary strand thereto. Column 7 in Table 1B.1 lists residues comprising epitopes contained in the polypeptides encoded by the preferred ORF (SEQ ID NO:Y), as predicted using the algorithm of Jameson and Wolf, (1988) Comp. Appl. Biosci. 4:181-186. The Jameson-Wolf antigenic analysis was performed using the computer program PROTEAN (Version 3.11 for the Power MacIntosh, DNASTAR, Inc., 1228 South Park Street Madison, Wis.). In specific embodiments, polypeptides of the invention comprise, or alternatively consist of, at least one, two, three, four, five or more of the predicted epitopes as described in Table 1B. It will be appreciated that depending on the analytical criteria used to predict antigenic determinants, the exact address of the determinant may vary slightly.

Column 8 in Table 1B.1 provides a chromosomal map location for certain polynucleotides of the invention. Chromosomal location was determined by finding exact matches to EST and cDNA sequences contained in the NCBI (National Center for Biotechnology Information) UniGene database. Each sequence in the UniGene database is assigned to a "cluster"; all of the ESTs, cDNAs, and STSs in a cluster are believed to be derived from a single gene. Chromosomal mapping data is often available for one or more sequence(s) in a UniGene cluster; this data (if consistent) is then applied to the cluster as a whole. Thus, it is possible to infer the chromosomal location of a new polynucleotide sequence by determining its identity with a mapped UniGene cluster.

A modified version of the computer program BLASTN (Altshul, et al., J. Mol. Biol. 215:403-410 (1990), and Gish, and States, Nat. Genet. 3:266-272) (1993) was used to search the UniGene database for EST or cDNA sequences that contain exact or near-exact matches to a polynucleotide sequence of the invention (the 'Query'). A sequence from the UniGene database (the 'Subject') was said to be an exact match if it contained a segment of 50 nucleotides in length such that 48 of those nucleotides were in the same order as found in the Query sequence. If all of the matches that met this criteria were in the same UniGene cluster, and mapping data was available for this cluster, it is indicated in Table 1B under the heading "Cytologic Band". Where a cluster had been further localized to a distinct cytologic band, that band is disclosed; where no banding information was available, but the gene had been localized to a single chromosome, the chromosome is disclosed.

Once a presumptive chromosomal location was determined for a polynucleotide of the invention, an associated disease locus was identified by comparison with a database of diseases which have been experimentally associated with genetic loci. The database used was the Morbid Map, derived from OMIM™ and National Center for Biotechnology Information, National Library of Medicine (Bethesda, Md.) 2000. If the putative chromosomal location of a polynucleotide of the invention (Query sequence) was associated with a disease in the Morbid Map database, an OMIM reference identification number was noted in column 9, Table 1B.1, labelled "OMIM Disease Reference(s). Table 5 is a key to the OMIM reference identification numbers (column 1), and provides a description of the associated disease in Column 2.

Table 1B.2

Column 5, in Table 1B.2, provides an expression profile and library Code:Count for each of the contig sequences (SEQ ID NO:X) disclosed in Table 1B, which can routinely be combined with the information provided in Table 4 and used to determine the tissues, cells, and/or cell line libraries which predominantly express the polynucleotides of the invention. The first number in Table 1B.2, column 5 (preceding the colon), represents the tissue/cell source identifier code corresponding to the code and description provided in Table 4. The second number in column 5 (following the colon) represents the number of times a sequence corresponding to the reference polynucleotide sequence was identified in the corresponding tissue/cell source. Those tissue/cell source identifier codes in which the first two letters are "AR" designate information generated using DNA array technology. Utilizing this technology, cDNAs were amplified by PCR and then transferred, in duplicate, onto the array. Gene expression was assayed through hybridization of first strand cDNA probes to the DNA array. cDNA probes were generated from total RNA extracted from a variety of different tissues and cell lines. Probe synthesis was performed in the presence of $^{33}$P dCTP, using oligo (dT) to prime reverse transcription. After hybridization, high stringency washing conditions were employed to remove non-specific hybrids from the array. The remaining signal, emanating from each gene target, was measured using a Phosphorimager. Gene expression was reported as Phosphor Stimulating Luminescence (PSL) which reflects the level of phosphor signal generated from the probe hybridized to each of the gene targets represented on the array. A local background signal subtraction was performed before the total signal generated from each array was used to normalize gene expression between the different hybridizations. The value presented after "[array code]:" represents the mean of the duplicate values, following background subtraction and probe normalization. One of skill in the art could routinely use this information to identify normal and/or diseased tissue(s) which show a predominant expression pattern of the corresponding polynucleotide of the invention or to identify polynucleotides which show predominant and/or specific tissue and/or cell expression.

Lengthy table referenced here

US07411051-20080812-T00002

Please refer to the end of the specification for access instructions.

Lengthy table referenced here

US07411051-20080812-T00003

Please refer to the end of the specification for access instructions.

Table 1C summarizes additional polynucleotides encompassed by the invention (including cDNA clones related to the sequences (Clone ID:), contig sequences (contig identifier (Contig ID:) contig nucleotide sequence identifiers (SEQ ID NO:X)), and genomic sequences (SEQ ID NO:B). The first column provides a unique clone identifier, "Clone ID:", for a cDNA clone related to each contig sequence. The second column provides the sequence identifier, "SEQ ID NO:X", for each contig sequence. The third column provides a unique contig identifier, "Contig ID:" for each contig sequence. The fourth column, provides a BAC identifier "BAC ID NO:A" for the BAC clone referenced in the corresponding row of the table. The fifth column provides the nucleotide sequence identifier, "SEQ ID NO:B" for a fragment of the BAC clone identified in column four of the corresponding row of the table. The sixth column, "Exon From-To", provides the location (i.e., nucleotide position numbers) within the polynucleotide sequence of SEQ ID NO:B which delineate certain polynucleotides of the invention that are also exemplary members of polynucleotide sequences that encode polypeptides of the invention (e.g., polypeptides containing amino acid sequences encoded by the polynucleotide sequences delineated in column six, and fragments and variants thereof).

TABLE 1C

| cDNA Clone ID | SEQ ID NO: X | CONTIG ID: | BAC ID: A | SEQ ID NO: B | EXON From-To |
|---|---|---|---|---|---|
| HAGAN21 | 25 | 1026956 | AC011967 | 11231 | 1–839 |
| HAGAN21 | 25 | 1026956 | AC074370 | 11232 | 1–839 |
| HAGAN21 | 25 | 1026956 | AL355151 | 11233 | 1–837 |
| HAGAN21 | 25 | 1026956 | AL121796 | 11234 | 1–836 |

TABLE 1C-continued

| cDNA Clone ID | SEQ ID NO: X | CONTIG ID: | BAC ID: A | SEQ ID NO: B | EXON From-To |
|---|---|---|---|---|---|
| HAGAN21 | 25 | 1026956 | AC011967 | 11235 | 1–367 |
| | | | | | 372–1167 |
| | | | | | 1180–1791 |
| | | | | | 3777–4078 |
| | | | | | 4113–4269 |
| HAGAN21 | 25 | 1026956 | AC074370 | 11236 | 1–366 |
| | | | | | 373–1167 |
| | | | | | 1180–1793 |
| | | | | | 3779–4081 |
| | | | | | 4117–4273 |
| HAGAN21 | 25 | 1026956 | AL355151 | 11237 | 1–364 |
| | | | | | 373–1166 |
| | | | | | 1179–1790 |
| | | | | | 3780–4082 |
| HAGAN21 | 25 | 1026956 | AL121796 | 11238 | 1–367 |
| | | | | | 374–1165 |
| | | | | | 1178–1791 |
| | | | | | 3767–4069 |
| | | | | | 4105–4262 |
| HAIBP89 | 35 | 727543 | AC005214 | 11239 | 1–228 |
| | | | | | 817–3471 |
| HAIBP89 | 35 | 727543 | AC005214 | 11240 | 1–539 |
| HATDM46 | 60 | 974065 | AC068289 | 11241 | 1–2303 |
| HATDM46 | 60 | 974065 | AC068289 | 11242 | 1–101 |
| HATDM46 | 60 | 974065 | AC068289 | 11243 | 1–160 |
| HAUAI83 | 62 | 639009 | AC010422 | 11244 | 1–326 |
| | | | | | 1552–2084 |
| | | | | | 2162–2261 |
| | | | | | 2300–2427 |
| | | | | | 4485–5868 |
| | | | | | 5948–6362 |
| | | | | | 7914–8017 |
| | | | | | 8569–8681 |
| | | | | | 8765–8875 |
| | | | | | 8968–9037 |
| | | | | | 9284–9499 |
| | | | | | 9742–9910 |
| | | | | | 10837–11187 |
| | | | | | 11271–11321 |
| | | | | | 11554–11707 |
| | | | | | 11783–12766 |
| | | | | | 12866–13225 |
| | | | | | 13256–13827 |
| | | | | | 14284–14367 |
| | | | | | 14890–15090 |
| HAUAI83 | 62 | 639009 | AC018761 | 11245 | 1–326 |
| | | | | | 1176–1284 |
| | | | | | 1552–2084 |
| | | | | | 2162–2261 |
| | | | | | 2300–2426 |
| | | | | | 4485–5868 |
| | | | | | 5948–6362 |
| | | | | | 8569–8681 |
| | | | | | 8765–8875 |
| | | | | | 8968–9037 |
| | | | | | 9284–9499 |
| | | | | | 9742–9910 |
| | | | | | 10317–10501 |
| | | | | | 10837–11187 |
| | | | | | 11271–11321 |
| | | | | | 11554–11707 |
| | | | | | 11783–12766 |
| | | | | | 12866–13225 |
| | | | | | 13256–13827 |
| | | | | | 14284–14367 |
| | | | | | 14890–15090 |
| HAUAI83 | 62 | 639009 | AC010422 | 11246 | 1–315 |
| | | | | | 2004–2289 |
| | | | | | 2650–2741 |
| | | | | | 3554–3830 |
| HAUAI83 | 62 | 639009 | AC010422 | 11247 | 1–202 |
| | | | | | 938–1047 |
| | | | | | 1219–1395 |
| | | | | | 1758–1956 |
| | | | | | 2907–3429 |
| | | | | | 3792–3935 |
| | | | | | 5366–5485 |
| | | | | | 6391–6688 |
| | | | | | 6899–7269 |
| | | | | | 7890–8316 |
| | | | | | 8400–8524 |
| | | | | | 8607–8682 |
| | | | | | 8824–8999 |
| | | | | | 9190–9302 |
| | | | | | 9691–9796 |
| | | | | | 10106–10177 |
| | | | | | 10571–11051 |
| | | | | | 11164–11490 |
| | | | | | 12565–12696 |
| | | | | | 13364–13501 |
| | | | | | 13964–14592 |
| | | | | | 14740–15540 |
| | | | | | 15610–15798 |
| | | | | | 15947–16642 |
| | | | | | 16717–16832 |
| | | | | | 16968–17408 |
| | | | | | 17521–17612 |
| | | | | | 18331–18579 |
| | | | | | 19120–19303 |
| | | | | | 19358–19514 |
| | | | | | 19599–19702 |
| | | | | | 20003–20245 |
| HAUAI83 | 62 | 639009 | AC018761 | 11248 | 1–202 |
| | | | | | 938–1047 |
| | | | | | 1219–1395 |
| | | | | | 1758–1956 |
| | | | | | 2907–3429 |
| | | | | | 3792–3935 |
| | | | | | 5366–5485 |
| | | | | | 6391–6688 |
| | | | | | 6899–7269 |
| | | | | | 7591–7711 |
| | | | | | 7890–8316 |
| | | | | | 8400–8524 |
| | | | | | 8607–8682 |
| | | | | | 8749–9073 |
| | | | | | 9190–9302 |
| | | | | | 9691–9796 |
| HAUAI83 | 62 | 639009 | AC018761 | 11249 | 1–82 |
| | | | | | 128–293 |
| | | | | | 1178–1447 |
| | | | | | 1986–2278 |
| | | | | | 2457–2711 |
| | | | | | 3543–3844 |
| HBCPB32 | 67 | 1352403 | AC024191 | 11250 | 1–643 |
| | | | | | 1421–1636 |
| | | | | | 4917–5536 |
| HBINS58 | 74 | 1352386 | AL096774 | 11251 | 1–1023 |
| | | | | | 2010–2239 |
| | | | | | 2581–2962 |
| | | | | | 3153–3223 |
| | | | | | 3324–3493 |
| | | | | | 3973–4126 |
| HBINS58 | 74 | 1352386 | AL096774 | 11252 | 1–341 |
| HBINS58 | 74 | 1352386 | AL096774 | 11253 | 1–142 |
| HBOEG11 | 82 | 1300752 | AL139352 | 11254 | 1–253 |
| | | | | | 438–539 |
| | | | | | 2336–2801 |
| | | | | | 4986–5209 |
| | | | | | 5967–6439 |
| | | | | | 9014–9452 |
| | | | | | 9829–10084 |
| | | | | | 10404–10503 |
| | | | | | 12165–13255 |
| HBOEG11 | 82 | 1300752 | AL139352 | 11255 | 1–559 |
| HCE3G69 | 89 | 728432 | AC068946 | 11256 | 1–108 |
| | | | | | 1186–1324 |
| | | | | | 1746–1835 |
| | | | | | 2138–2284 |
| | | | | | 2448–2545 |
| | | | | | 2718–2861 |
| | | | | | 3091–5889 |

TABLE 1C-continued

| cDNA Clone ID | SEQ ID NO: X | CONTIG ID: | BAC ID: A | SEQ ID NO: B | EXON From-To |
|---|---|---|---|---|---|
| HCE3G69 | 89 | 728432 | AC068946 | 11257 | 1–191 |
| HCE3G69 | 89 | 728432 | AC068946 | 11258 | 1–686 |
| HCEFB80 | 91 | 1143407 | AL022327 | 11259 | 1–2271 |
|  |  |  |  |  | 3506–3658 |
|  |  |  |  |  | 4643–4810 |
|  |  |  |  |  | 9039–9164 |
|  |  |  |  |  | 9382–9509 |
|  |  |  |  |  | 10587–10720 |
|  |  |  |  |  | 11135–11195 |
|  |  |  |  |  | 11265–11716 |
|  |  |  |  |  | 14644–15466 |
|  |  |  |  |  | 17451–17526 |
|  |  |  |  |  | 18012–18114 |
|  |  |  |  |  | 20530–20632 |
|  |  |  |  |  | 20957–21009 |
|  |  |  |  |  | 23696–23785 |
|  |  |  |  |  | 25338–25575 |
|  |  |  |  |  | 25969–26166 |
| HCEWE17 | 95 | 941941 | AL139130 | 11260 | 1–170 |
|  |  |  |  |  | 463–598 |
|  |  |  |  |  | 623–1346 |
|  |  |  |  |  | 1404–1523 |
|  |  |  |  |  | 2059–2159 |
|  |  |  |  |  | 2350–2616 |
|  |  |  |  |  | 3068–3254 |
|  |  |  |  |  | 3428–3878 |
| HCNDR47 | 106 | 1016919 | AL122003 | 11261 | 1–236 |
|  |  |  |  |  | 531–696 |
|  |  |  |  |  | 787–817 |
|  |  |  |  |  | 863–4508 |
|  |  |  |  |  | 5158–5744 |
|  |  |  |  |  | 6949–7029 |
| HCNDR47 | 106 | 1016919 | AL122003 | 11262 | 1–888 |
|  |  |  |  |  | 1304–2003 |
|  |  |  |  |  | 2830–3284 |
|  |  |  |  |  | 3719–4571 |
|  |  |  |  |  | 4618–5268 |
|  |  |  |  |  | 6131–6557 |
|  |  |  |  |  | 8947–9033 |
|  |  |  |  |  | 9058–9726 |
|  |  |  |  |  | 14176–14480 |
|  |  |  |  |  | 18456–18915 |
|  |  |  |  |  | 18960–19871 |
|  |  |  |  |  | 22365–22454 |
|  |  |  |  |  | 23082–23248 |
|  |  |  |  |  | 28058–28215 |
| HCOOS80 | 109 | 1134974 | AC003688 | 11263 | 1–718 |
|  |  |  |  |  | 1054–1158 |
|  |  |  |  |  | 1660–1980 |
|  |  |  |  |  | 4003–4073 |
|  |  |  |  |  | 4364–4516 |
|  |  |  |  |  | 4646–4749 |
|  |  |  |  |  | 4852–4995 |
|  |  |  |  |  | 5121–5213 |
|  |  |  |  |  | 5354–5424 |
|  |  |  |  |  | 5526–5669 |
|  |  |  |  |  | 5759–5832 |
|  |  |  |  |  | 5850–6176 |
|  |  |  |  |  | 6756–6829 |
|  |  |  |  |  | 7023–7175 |
|  |  |  |  |  | 7259–7398 |
|  |  |  |  |  | 7531–7711 |
|  |  |  |  |  | 8134–8381 |
|  |  |  |  |  | 8463–13585 |
|  |  |  |  |  | 13691–14323 |
|  |  |  |  |  | 14437–14918 |
| HCOOS80 | 109 | 1134974 | AC026954 | 11264 | 1–138 |
|  |  |  |  |  | 273–453 |
|  |  |  |  |  | 876–1123 |
|  |  |  |  |  | 1205–4456 |
| HCOOS80 | 109 | 1134974 | AC003688 | 11265 | 1–125 |
|  |  |  |  |  | 203–480 |
|  |  |  |  |  | 1463–1647 |
|  |  |  |  |  | 2048–2077 |
|  |  |  |  |  | 2229–2323 |
|  |  |  |  |  | 2725–3784 |
|  |  |  |  |  | 3867–4682 |
| HCWGU37 | 119 | 1042325 | AC007459 | 11266 | 1–242 |
| HCWGU37 | 119 | 1042325 | AC022435 | 11267 | 1–218 |
|  |  |  |  |  | 5587–5754 |
| HCWGU37 | 119 | 1042325 | AC022051 | 11268 | 1–294 |
| HCWGU37 | 119 | 1042325 | AC023672 | 11269 | 1–196 |
| HCWGU37 | 119 | 1042325 | AC011101 | 11270 | 1–100 |
| HCWGU37 | 119 | 1042325 | AC034243 | 11271 | 1–312 |
|  |  |  |  |  | 2334–2364 |
| HCWGU37 | 119 | 1042325 | AC010454 | 11272 | 1–218 |
|  |  |  |  |  | 5588–5755 |
| HCWGU37 | 119 | 1042325 | AC026144 | 11273 | 1–183 |
| HCWGU37 | 119 | 1042325 | AC009691 | 11274 | 1–292 |
| HCWGU37 | 119 | 1042325 | AL354696 | 11275 | 1–181 |
| HCWGU37 | 119 | 1042325 | AC073219 | 11276 | 1–123 |
| HCWGU37 | 119 | 1042325 | AC027414 | 11277 | 1–270 |
| HCWGU37 | 119 | 1042325 | AC010454 | 11278 | 1–303 |
| HDPGT01 | 141 | 771583 | AC020978 | 11279 | 1–180 |
|  |  |  |  |  | 2776–2899 |
|  |  |  |  |  | 3916–4077 |
|  |  |  |  |  | 4296–4335 |
|  |  |  |  |  | 4436–4632 |
|  |  |  |  |  | 4895–5181 |
|  |  |  |  |  | 8153–8246 |
|  |  |  |  |  | 9547–9666 |
|  |  |  |  |  | 9907–10007 |
|  |  |  |  |  | 10370–10618 |
|  |  |  |  |  | 10788–11046 |
|  |  |  |  |  | 11926–13423 |
|  |  |  |  |  | 13465–13494 |
|  |  |  |  |  | 13764–15689 |
| HDPGT01 | 141 | 771583 | AC020978 | 11280 | 1–384 |
| HDPSB18 | 154 | 1043263 | AL355512 | 11281 | 1–2572 |
|  |  |  |  |  | 3049–3871 |
| HDPSB18 | 154 | 1043263 | AC006176 | 11282 | 1–2571 |
|  |  |  |  |  | 3048–3872 |
| HDPSB18 | 154 | 1043263 | AL355512 | 11283 | 1–280 |
| HDPWN93 | 165 | 992925 | AC004590 | 11284 | 1–276 |
|  |  |  |  |  | 489–591 |
|  |  |  |  |  | 866–988 |
|  |  |  |  |  | 1106–1281 |
|  |  |  |  |  | 1323–1444 |
|  |  |  |  |  | 1632–1799 |
|  |  |  |  |  | 1866–2016 |
|  |  |  |  |  | 2109–2313 |
|  |  |  |  |  | 2634–3205 |
|  |  |  |  |  | 3360–3472 |
|  |  |  |  |  | 3528–3744 |
|  |  |  |  |  | 3820–5006 |
|  |  |  |  |  | 6580–6919 |
|  |  |  |  |  | 7076–7276 |
|  |  |  |  |  | 8057–8153 |
|  |  |  |  |  | 8318–8680 |
| HDPWN93 | 165 | 992925 | AC021491 | 11285 | 1–275 |
|  |  |  |  |  | 488–590 |
|  |  |  |  |  | 865–987 |
|  |  |  |  |  | 1105–1280 |
|  |  |  |  |  | 1322–1443 |
|  |  |  |  |  | 1631–1798 |
|  |  |  |  |  | 1865–2015 |
|  |  |  |  |  | 2108–2312 |
|  |  |  |  |  | 2633–3204 |
|  |  |  |  |  | 3359–3471 |
|  |  |  |  |  | 3527–3743 |
|  |  |  |  |  | 3819–5005 |
|  |  |  |  |  | 6579–6918 |
|  |  |  |  |  | 7075–7275 |
|  |  |  |  |  | 8054–8150 |
|  |  |  |  |  | 8315–8677 |
| HDPWN93 | 165 | 992925 | AC004590 | 11286 | 1–303 |
|  |  |  |  |  | 727–1252 |
|  |  |  |  |  | 5721–5846 |
| HDPWN93 | 165 | 992925 | AC021491 | 11287 | 1–303 |
|  |  |  |  |  | 727–1253 |
|  |  |  |  |  | 5723–5848 |
| HDPXY01 | 167 | 879048 | AL354000 | 11288 | 1–1319 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 4848–4975 |
| | | | | | 5229–5600 |
| | | | | | 6561–6654 |
| HDPXY01 | 167 | 879048 | AL035362 | 11289 | 1–1316 |
| | | | | | 4844–4971 |
| | | | | | 5225–5596 |
| | | | | | 6557–6650 |
| HDPXY01 | 167 | 879048 | AL354000 | 11290 | 1–460 |
| HDPXY01 | 167 | 879048 | AL354000 | 11291 | 1–400 |
| HDPXY01 | 167 | 879048 | AL035362 | 11292 | 1–400 |
| HDPXY01 | 167 | 879048 | AL035362 | 11293 | 1–460 |
| HDTEK44 | 172 | 1025421 | AC022100 | 11294 | 1–2932 |
| HDTEK44 | 172 | 1025421 | AC022100 | 11295 | 1–353 |
| HDTFE17 | 174 | 1043391 | AF196972 | 11296 | 1–74 |
| | | | | | 391–524 |
| | | | | | 1481–1536 |
| | | | | | 1623–1699 |
| | | | | | 2092–2448 |
| | | | | | 2537–2611 |
| | | | | | 3085–3179 |
| | | | | | 3315–3395 |
| | | | | | 6429–6514 |
| | | | | | 6997–7407 |
| | | | | | 7611–7693 |
| | | | | | 8316–8774 |
| | | | | | 9534–9680 |
| | | | | | 9770–9875 |
| | | | | | 10373–10876 |
| HDTFE17 | 174 | 1043391 | AF196972 | 11297 | 1–742 |
| HDTMK50 | 177 | 1011485 | AL354768 | 11298 | 1–1340 |
| HDTMK50 | 177 | 1011485 | AC012318 | 11299 | 1–147 |
| HDTMK50 | 177 | 1011485 | AL354768 | 11300 | 1–590 |
| HE8QV67 | 189 | 1050076 | AL133410 | 11301 | 1–765 |
| | | | | | 4403–4496 |
| | | | | | 4696–4813 |
| | | | | | 5112–5584 |
| | | | | | 5780–5830 |
| | | | | | 5850–7766 |
| | | | | | 7774–8284 |
| | | | | | 8479–8902 |
| | | | | | 8986–9110 |
| | | | | | 9305–9481 |
| | | | | | 9658–9944 |
| | | | | | 9998–10106 |
| | | | | | 10202–12718 |
| | | | | | 12797–12886 |
| | | | | | 12974–13063 |
| | | | | | 13259–14645 |
| | | | | | 14680–14941 |
| | | | | | 15625–15714 |
| | | | | | 15825–15895 |
| | | | | | 15965–16114 |
| | | | | | 16204–16772 |
| HE8QV67 | 189 | 1050076 | AL133410 | 11302 | 1–85 |
| | | | | | 1082–1951 |
| | | | | | 2761–3118 |
| HE8QV67 | 189 | 1050076 | AL133410 | 11303 | 1–26 |
| | | | | | 28–267 |
| | | | | | 828–3952 |
| | | | | | 4173–4837 |
| | | | | | 4930–6955 |
| | | | | | 7105–7230 |
| | | | | | 7451–7655 |
| | | | | | 7842–7947 |
| | | | | | 8245–8329 |
| | | | | | 8599–8756 |
| | | | | | 8855–8940 |
| | | | | | 9219–9356 |
| | | | | | 9728–9861 |
| | | | | | 10190–10231 |
| HEBBN36 | 199 | 486120 | AC005180 | 11304 | 1–341 |
| | | | | | 704–1559 |
| | | | | | 1704–3089 |
| | | | | | 3146–4166 |
| | | | | | 4768–4871 |
| | | | | | 5384–5485 |
| | | | | | 5535–6182 |
| | | | | | 6595–7328 |
| HEBBN36 | 199 | 486120 | AC002557 | 11305 | 1–1387 |
| HEBBN36 | 199 | 486120 | AC002557 | 11306 | 1–856 |
| HEBBN36 | 199 | 486120 | AC002557 | 11307 | 1–971 |
| HETLM70 | 224 | 1177512 | AC012314 | 11308 | 1–43 |
| | | | | | 861–1031 |
| | | | | | 1576–1743 |
| | | | | | 1924–2132 |
| | | | | | 2203–2432 |
| | | | | | 2473–2905 |
| | | | | | 3177–3360 |
| | | | | | 3651–4332 |
| | | | | | 4422–4583 |
| | | | | | 4830–4995 |
| | | | | | 5086–5365 |
| HETLM70 | 224 | 1177512 | AC009968 | 11309 | 1–43 |
| | | | | | 857–1027 |
| | | | | | 1570–1737 |
| | | | | | 1918–2126 |
| | | | | | 2197–2426 |
| | | | | | 2467–2899 |
| | | | | | 3171–3354 |
| | | | | | 3644–4326 |
| | | | | | 4416–4577 |
| | | | | | 4824–4989 |
| | | | | | 5080–5360 |
| HETLM70 | 224 | 1177512 | AC012314 | 11310 | 1–181 |
| | | | | | 1281–1463 |
| | | | | | 2719–2983 |
| | | | | | 3158–3411 |
| | | | | | 3804–6347 |
| | | | | | 6745–6879 |
| | | | | | 7118–7319 |
| | | | | | 7420–7521 |
| | | | | | 7859–8305 |
| | | | | | 8552–8602 |
| | | | | | 9988–10334 |
| | | | | | 10415–10778 |
| | | | | | 11003–11127 |
| | | | | | 11210–11303 |
| | | | | | 11334–11832 |
| | | | | | 13093–13145 |
| | | | | | 13703–13837 |
| | | | | | 13918–14152 |
| | | | | | 15415–15511 |
| | | | | | 15613–15742 |
| | | | | | 15998–16087 |
| | | | | | 16231–16307 |
| | | | | | 16447–17211 |
| | | | | | 18520–18796 |
| | | | | | 21777–22001 |
| HETLM70 | 224 | 1177512 | AC009968 | 11311 | 1–180 |
| | | | | | 1275–1457 |
| | | | | | 2712–2976 |
| | | | | | 3150–3403 |
| | | | | | 3796–6332 |
| | | | | | 6730–6864 |
| | | | | | 7103–7303 |
| | | | | | 7404–7505 |
| | | | | | 7843–8289 |
| | | | | | 8536–8586 |
| | | | | | 9970–10312 |
| | | | | | 10393–10756 |
| | | | | | 10981–11105 |
| | | | | | 11188–11805 |
| | | | | | 13068–13120 |
| | | | | | 13678–13812 |
| | | | | | 13905–13994 |
| HFIIN69 | 235 | 1011487 | AC027797 | 11312 | 1–1438 |
| HFIIN69 | 235 | 1011487 | AC027797 | 11313 | 1–329 |
| HFVGE32 | 249 | 854545 | AL160269 | 11314 | 1–1122 |
| HFVGE32 | 249 | 854545 | AL138754 | 11315 | 1–1120 |
| HHBCS39 | 268 | 1003028 | AL390960 | 11316 | 1–2979 |
| HHBCS39 | 268 | 1003028 | AL358992 | 11317 | 1–2983 |
| HHBCS39 | 268 | 1003028 | AL358992 | 11318 | 1–207 |

TABLE 1C-continued

| cDNA Clone ID | SEQ ID NO: X | CONTIG ID: | BAC ID: A | SEQ ID NO: B | EXON From-To |
|---|---|---|---|---|---|
| HHEPD24 | 277 | 498227 | AC025937 | 11319 | 1–216 |
| HHGCG53 | 289 | 340818 | AC024037 | 11320 | 1–518 |
| HHGCM76 | 290 | 662329 | AC003665 | 11321 | 1–70 |
|  |  |  |  |  | 304–609 |
|  |  |  |  |  | 900–1090 |
|  |  |  |  |  | 1240–1835 |
|  |  |  |  |  | 2272–2490 |
|  |  |  |  |  | 2581–3598 |
| HHGCM76 | 290 | 662329 | AC003665 | 11322 | 1–580 |
|  |  |  |  |  | 851–995 |
|  |  |  |  |  | 1224–1296 |
|  |  |  |  |  | 1314–1663 |
|  |  |  |  |  | 1930–1975 |
|  |  |  |  |  | 2724–2905 |
|  |  |  |  |  | 2968–3098 |
|  |  |  |  |  | 3283–3328 |
|  |  |  |  |  | 5121–5230 |
|  |  |  |  |  | 5331–5689 |
| HHSGW69 | 299 | 1031514 | AC019095 | 11323 | 1–348 |
|  |  |  |  |  | 469–577 |
|  |  |  |  |  | 634–961 |
|  |  |  |  |  | 1102–1387 |
|  |  |  |  |  | 1750–1842 |
|  |  |  |  |  | 1855–3008 |
| HHSGW69 | 299 | 1031514 | AC019095 | 11324 | 1–282 |
| HJACG30 | 303 | 895505 | AC018512 | 11325 | 1–776 |
| HJACG30 | 303 | 895505 | AC022305 | 11326 | 1–878 |
| HJACG30 | 303 | 895505 | AC002518 | 11327 | 1–150 |
| HKACM93 | 321 | 1352383 | AL158848 | 11328 | 1–431 |
|  |  |  |  |  | 4227–4418 |
|  |  |  |  |  | 6907–7028 |
|  |  |  |  |  | 12393–12788 |
|  |  |  |  |  | 13026–13171 |
|  |  |  |  |  | 14505–14634 |
|  |  |  |  |  | 14659–14701 |
|  |  |  |  |  | 15118–15405 |
|  |  |  |  |  | 16371–16568 |
|  |  |  |  |  | 17704–17888 |
|  |  |  |  |  | 18408–18580 |
|  |  |  |  |  | 18868–19021 |
|  |  |  |  |  | 19843–20023 |
|  |  |  |  |  | 21731–21911 |
|  |  |  |  |  | 23724–25211 |
| HKACM93 | 321 | 1352383 | AL158848 | 11329 | 1–2833 |
|  |  |  |  |  | 2990–3408 |
|  |  |  |  |  | 3932–5958 |
|  |  |  |  |  | 5960–6045 |
|  |  |  |  |  | 6428–6501 |
| HKGAT94 | 330 | 762811 | AC025388 | 11330 | 1–1040 |
|  |  |  |  |  | 1047–2356 |
|  |  |  |  |  | 2415–3968 |
| HKGAT94 | 330 | 762811 | AL109945 | 11331 | 1–1040 |
|  |  |  |  |  | 1047–2356 |
|  |  |  |  |  | 2415–3968 |
| HKGAT94 | 330 | 762811 | AC022307 | 11332 | 1–1040 |
|  |  |  |  |  | 1047–2356 |
|  |  |  |  |  | 2415–3968 |
| HKGAT94 | 330 | 762811 | AC025388 | 11333 | 1–506 |
| HKGAT94 | 330 | 762811 | AL109945 | 11334 | 1–506 |
| HKGAT94 | 330 | 762811 | AL109945 | 11335 | 1–456 |
| HKGAT94 | 330 | 762811 | AC022307 | 11336 | 1–479 |
| HKGAT94 | 330 | 762811 | AC022307 | 11337 | 1–506 |
| HLJBJ61 | 355 | 1019012 | AC010422 | 11338 | 1–326 |
|  |  |  |  |  | 1552–2084 |
|  |  |  |  |  | 2162–2261 |
|  |  |  |  |  | 2300–2427 |
|  |  |  |  |  | 4485–5868 |
|  |  |  |  |  | 5948–6362 |
|  |  |  |  |  | 7914–8017 |
|  |  |  |  |  | 8569–8681 |
|  |  |  |  |  | 8765–8875 |
|  |  |  |  |  | 8968–9037 |
|  |  |  |  |  | 9284–9499 |
|  |  |  |  |  | 9742–9910 |
|  |  |  |  |  | 10837–11187 |
|  |  |  |  |  | 11271–11321 |
|  |  |  |  |  | 11554–11707 |
|  |  |  |  |  | 11783–12766 |
|  |  |  |  |  | 12866–13225 |
|  |  |  |  |  | 13256–13827 |
|  |  |  |  |  | 14284–14367 |
|  |  |  |  |  | 14890–15090 |
| HLJBJ61 | 355 | 1019012 | AC018761 | 11339 | 1–326 |
|  |  |  |  |  | 1176–1284 |
|  |  |  |  |  | 1552–2084 |
|  |  |  |  |  | 2162–2261 |
|  |  |  |  |  | 2300–2426 |
|  |  |  |  |  | 4485–5868 |
|  |  |  |  |  | 5948–6362 |
|  |  |  |  |  | 8569–8681 |
|  |  |  |  |  | 8765–8875 |
|  |  |  |  |  | 8968–9037 |
|  |  |  |  |  | 9284–9499 |
|  |  |  |  |  | 9742–9910 |
|  |  |  |  |  | 10317–10501 |
|  |  |  |  |  | 10837–11187 |
|  |  |  |  |  | 11271–11321 |
|  |  |  |  |  | 11554–11707 |
|  |  |  |  |  | 11783–12766 |
|  |  |  |  |  | 12866–13225 |
|  |  |  |  |  | 13256–13827 |
|  |  |  |  |  | 14284–14367 |
|  |  |  |  |  | 14890–15090 |
| HLJBJ61 | 355 | 1019012 | AC010422 | 11340 | 1–315 |
|  |  |  |  |  | 2004–2289 |
|  |  |  |  |  | 2650–2741 |
|  |  |  |  |  | 3554–3830 |
| HLJBJ61 | 355 | 1019012 | AC010422 | 11341 | 1–202 |
|  |  |  |  |  | 938–1047 |
|  |  |  |  |  | 1219–1395 |
|  |  |  |  |  | 1758–1956 |
|  |  |  |  |  | 2907–3429 |
|  |  |  |  |  | 3792–3935 |
|  |  |  |  |  | 5366–5485 |
|  |  |  |  |  | 6391–6688 |
|  |  |  |  |  | 6899–7269 |
|  |  |  |  |  | 7890–8316 |
|  |  |  |  |  | 8400–8524 |
|  |  |  |  |  | 8607–8682 |
|  |  |  |  |  | 8824–8999 |
|  |  |  |  |  | 9190–9302 |
|  |  |  |  |  | 9691–9796 |
|  |  |  |  |  | 10106–10177 |
|  |  |  |  |  | 10571–11051 |
|  |  |  |  |  | 11164–11490 |
|  |  |  |  |  | 12565–12696 |
|  |  |  |  |  | 13364–13501 |
|  |  |  |  |  | 13964–14592 |
|  |  |  |  |  | 14740–15540 |
|  |  |  |  |  | 15610–15798 |
|  |  |  |  |  | 15947–16642 |
|  |  |  |  |  | 16717–16832 |
|  |  |  |  |  | 16968–17408 |
|  |  |  |  |  | 17521–17612 |
|  |  |  |  |  | 18331–18579 |
|  |  |  |  |  | 19120–19303 |
|  |  |  |  |  | 19358–19514 |
|  |  |  |  |  | 19599–19702 |
|  |  |  |  |  | 20003–20245 |
| HLJBJ61 | 355 | 1019012 | AC018761 | 11342 | 1–202 |
|  |  |  |  |  | 938–1047 |
|  |  |  |  |  | 1219–1395 |
|  |  |  |  |  | 1758–1956 |
|  |  |  |  |  | 2907–3429 |
|  |  |  |  |  | 3792–3935 |
|  |  |  |  |  | 5366–5485 |
|  |  |  |  |  | 6391–6688 |
|  |  |  |  |  | 6899–7269 |
|  |  |  |  |  | 7591–7711 |
|  |  |  |  |  | 7890–8316 |
|  |  |  |  |  | 8400–8524 |
|  |  |  |  |  | 8607–8682 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 8749–9073 |
| | | | | | 9190–9302 |
| | | | | | 9691–9796 |
| HLJBJ61 | 355 | 1019012 | AC018761 | 11343 | 1–82 |
| | | | | | 128–293 |
| | | | | | 1178–1447 |
| | | | | | 1986–2278 |
| | | | | | 2457–2711 |
| | | | | | 3543–3844 |
| HLTIP94 | 368 | 1087335 | AC007431 | 11344 | 1–1299 |
| HLTIP94 | 368 | 1087335 | AC007431 | 11345 | 1–330 |
| HMSDL37 | 407 | 973996 | AC012086 | 11346 | 1–3328 |
| HMSDL37 | 407 | 973996 | AC018811 | 11347 | 1–3051 |
| HMSDL37 | 407 | 973996 | AC018494 | 11348 | 1–3029 |
| HMSDL37 | 407 | 973996 | AC012086 | 11349 | 1–224 |
| HMSDL37 | 407 | 973996 | AC012086 | 11350 | 1–468 |
| HMSDL37 | 407 | 973996 | AC018811 | 11351 | 1–222 |
| HMSDL37 | 407 | 973996 | AC018811 | 11352 | 1–468 |
| HMSDL37 | 407 | 973996 | AC018494 | 11353 | 1–224 |
| HMSDL37 | 407 | 973996 | AC018494 | 11354 | 1–1854 |
| HNGBC07 | 437 | 1037631 | AL022339 | 11355 | 1–1583 |
| HNGIH43 | 446 | 410179 | AC018980 | 11356 | 1–83 |
| | | | | | 3147–4045 |
| | | | | | 4401–4443 |
| HNGIH43 | 446 | 410179 | AC018977 | 11357 | 1–604 |
| HNGIH43 | 446 | 410179 | AL356243 | 11358 | 1–83 |
| | | | | | 3146–4044 |
| | | | | | 4400–4442 |
| HNGIH43 | 446 | 410179 | AC018980 | 11359 | 1–872 |
| HNGOI12 | 452 | 1041375 | AC003675 | 11360 | 1–2128 |
| HNGOI12 | 452 | 1041375 | AC001228 | 11361 | 1–2129 |
| HNGOI12 | 452 | 1041375 | AC013791 | 11362 | 1–2132 |
| HNHFM14 | 465 | 664507 | AC020552 | 11363 | 1–290 |
| HNHFM14 | 465 | 664507 | AC020552 | 11364 | 1–96 |
| HNTSY18 | 476 | 1041383 | AC004877 | 11365 | 1–175 |
| | | | | | 342–474 |
| | | | | | 573–1883 |
| | | | | | 2536–2632 |
| | | | | | 2831–2894 |
| | | | | | 2999–3231 |
| | | | | | 5032–5164 |
| | | | | | 6664–6820 |
| | | | | | 7288–7881 |
| HNTSY18 | 476 | 1041383 | AC004877 | 11366 | 1–42 |
| | | | | | 1197–1333 |
| | | | | | 1575–1698 |
| | | | | | 1936–1984 |
| | | | | | 2246–2304 |
| HOEDE28 | 491 | 1036480 | AC058820 | 11367 | 1–150 |
| | | | | | 412–580 |
| | | | | | 1115–1724 |
| | | | | | 1821–2461 |
| | | | | | 2640–4410 |
| HOEDE28 | 491 | 1036480 | AC058820 | 11368 | 1–533 |
| | | | | | 676–947 |
| | | | | | 959–1251 |
| HOHBY44 | 505 | 873264 | AC074201 | 11369 | 1–5280 |
| | | | | | 5527–5989 |
| | | | | | 7392–7421 |
| HOHBY44 | 505 | 873264 | AC074201 | 11370 | 1–298 |
| HPDWP28 | 521 | 1094609 | AP000067 | 11371 | 1–818 |
| | | | | | 981–1337 |
| | | | | | 1583–1823 |
| | | | | | 2236–2371 |
| HPDWP28 | 521 | 1094609 | AP000067 | 11372 | 1–129 |
| HPICB53 | 527 | 1042309 | AC002351 | 11373 | 1–82 |
| | | | | | 959–2236 |
| HPICB53 | 527 | 1042309 | AC020997 | 11374 | 1–1329 |
| HPICB53 | 527 | 1042309 | AC002351 | 11375 | 1–115 |
| HPICB53 | 527 | 1042309 | AC020997 | 11376 | 1–201 |
| | | | | | 1064–1126 |
| | | | | | 1665–2153 |
| | | | | | 2308–3502 |
| HPJBK12 | 529 | 1011467 | AC022033 | 11377 | 1–2649 |
| HPJBK12 | 529 | 1011467 | AC013541 | 11378 | 1–2649 |
| HPJBK12 | 529 | 1011467 | AC022033 | 11379 | 1–190 |
| HPJBK12 | 529 | 1011467 | AC013541 | 11380 | 1–190 |
| HPJCL22 | 530 | 1146674 | AC037447 | 11381 | 1–102 |
| | | | | | 373–826 |
| | | | | | 995–1315 |
| | | | | | 1450–1567 |
| | | | | | 2189–2515 |
| | | | | | 2599–2778 |
| | | | | | 3138–4132 |
| | | | | | 4537–4681 |
| | | | | | 4864–4998 |
| | | | | | 5144–5324 |
| | | | | | 5394–6211 |
| | | | | | 6816–6941 |
| | | | | | 7472–7647 |
| | | | | | 7791–8885 |
| | | | | | 9056–9368 |
| | | | | | 9506–9733 |
| | | | | | 9799–10100 |
| | | | | | 10277–10988 |
| | | | | | 11213–11751 |
| | | | | | 11783–11838 |
| | | | | | 11875–12474 |
| | | | | | 12592–13077 |
| HPJCL22 | 530 | 1146674 | AC022400 | 11382 | 1–102 |
| | | | | | 373–826 |
| | | | | | 995–1315 |
| | | | | | 1450–1567 |
| | | | | | 2189–2515 |
| | | | | | 2599–2778 |
| | | | | | 3138–4132 |
| | | | | | 4537–4681 |
| | | | | | 4864–4998 |
| | | | | | 5144–5324 |
| | | | | | 5394–6211 |
| | | | | | 6816–6941 |
| | | | | | 7472–7647 |
| | | | | | 7791–8885 |
| | | | | | 9056–9368 |
| | | | | | 9506–9733 |
| | | | | | 9799–10100 |
| | | | | | 10277–10988 |
| | | | | | 11213–11751 |
| | | | | | 11783–11837 |
| | | | | | 11874–12473 |
| | | | | | 12591–13076 |
| HPJCL22 | 530 | 1146674 | AC037447 | 11383 | 1–207 |
| HPJCL22 | 530 | 1146674 | AC037447 | 11384 | 1–2124 |
| HPJCL22 | 530 | 1146674 | AC022400 | 11385 | 1–207 |
| HPJCL22 | 530 | 1146674 | AC022400 | 11386 | 1–2124 |
| | | | | | 2470–2567 |
| | | | | | 2865–2971 |
| HPJEX20 | 532 | 1352420 | AL080251 | 11387 | 1–1821 |
| HPJEX20 | 532 | 1352420 | AL139283 | 11388 | 1–1821 |
| HPJEX20 | 532 | 1352420 | AL080251 | 11389 | 1–313 |
| HPJEX20 | 532 | 1352420 | AL139283 | 11390 | 1–313 |
| HPRAL78 | 538 | 1352342 | AC007783 | 11391 | 1–2334 |
| | | | | | 2508–3084 |
| | | | | | 3578–3890 |
| | | | | | 4198–4294 |
| | | | | | 4376–4623 |
| | | | | | 4712–5349 |
| | | | | | 5369–6088 |
| | | | | | 6527–7107 |
| | | | | | 7298–7392 |
| | | | | | 7730–7846 |
| | | | | | 9147–9476 |
| | | | | | 10487–10575 |
| | | | | | 10791–11298 |
| | | | | | 11485–11601 |
| | | | | | 11783–13009 |
| | | | | | 13207–13501 |
| | | | | | 13540–13772 |
| | | | | | 14439–14800 |
| | | | | | 14923–14983 |
| | | | | | 15133–15355 |
| | | | | | 15485–15653 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 16750–16805 |
| | | | | | 16894–17078 |
| | | | | | 17162–17219 |
| | | | | | 18003–18089 |
| | | | | | 21085–21146 |
| | | | | | 21358–21501 |
| HPRAL78 | 538 | 1352342 | AC007783 | 11392 | 1–308 |
| HPRAL78 | 538 | 1352342 | AC007783 | 11393 | 1–1024 |
| HPWAY46 | 543 | 1001560 | AC019036 | 11394 | 1–1399 |
| HPWAY46 | 543 | 1001560 | AC067828 | 11395 | 1–1399 |
| HPWAY46 | 543 | 1001560 | AC019036 | 11396 | 1–788 |
| HPWAY46 | 543 | 1001560 | AC067828 | 11397 | 1–788 |
| HRGBL78 | 554 | 910133 | AL359541 | 11398 | 1–254 |
| | | | | | 2777–3307 |
| | | | | | 3670–3823 |
| | | | | | 4113–4385 |
| | | | | | 4844–5381 |
| | | | | | 5995–7365 |
| HSAUK57 | 560 | 772554 | AC008860 | 11399 | 1–1344 |
| HSAUK57 | 560 | 772554 | AC025444 | 11400 | 1–1344 |
| HSAUK57 | 560 | 772554 | AC008860 | 11401 | 1–340 |
| HSAUK57 | 560 | 772554 | AC025444 | 11402 | 1–340 |
| HSAWD74 | 564 | 460527 | AC004951 | 11403 | 1–1651 |
| | | | | | 1740–2593 |
| HSAWD74 | 564 | 460527 | AC004951 | 11404 | 1–149 |
| HSAWD74 | 564 | 460527 | AC004951 | 11405 | 1–5057 |
| | | | | | 5082–8353 |
| | | | | | 8404–8996 |
| HSLJG37 | 589 | 1016920 | AC022608 | 11406 | 1–2406 |
| HSLJG37 | 589 | 1016920 | AC022608 | 11407 | 1–53 |
| | | | | | 430–718 |
| HSLJG37 | 589 | 1016920 | AC022608 | 11408 | 1–351 |
| HSODE04 | 593 | 906081 | Z99289 | 11409 | 1–1365 |
| HSXEQ06 | 608 | 1016924 | AL390254 | 11410 | 1–159 |
| | | | | | 3226–4594 |
| | | | | | 5783–7254 |
| | | | | | 7340–7720 |
| | | | | | 8172–13712 |
| HSXEQ06 | 608 | 1016924 | AL356017 | 11411 | 1–73 |
| | | | | | 505–680 |
| | | | | | 1625–2403 |
| | | | | | 5814–5972 |
| | | | | | 9035–10403 |
| | | | | | 11592–13063 |
| | | | | | 13149–13529 |
| | | | | | 13981–19521 |
| HSXEQ06 | 608 | 1016924 | AL390254 | 11412 | 1–126 |
| HSXEQ06 | 608 | 1016924 | AL356017 | 11413 | 1–126 |
| HSXEQ06 | 608 | 1016924 | AL356017 | 11414 | 1–42 |
| | | | | | 674–828 |
| | | | | | 3271–3406 |
| | | | | | 4251–4326 |
| | | | | | 5040–5180 |
| | | | | | 7884–8230 |
| | | | | | 8404–8621 |
| | | | | | 8735–8892 |
| | | | | | 10277–10417 |
| HSYAZ50 | 612 | 1027673 | AC007378 | 11415 | 1–2471 |
| HSYAZ50 | 612 | 1027673 | AC073041 | 11416 | 1–2471 |
| HSYAZ50 | 612 | 1027673 | AC007378 | 11417 | 1–467 |
| HSYAZ50 | 612 | 1027673 | AC073041 | 11418 | 1–467 |
| HTHBG43 | 643 | 919911 | AL139257 | 11419 | 1–36 |
| | | | | | 130–201 |
| | | | | | 330–753 |
| | | | | | 1823–2214 |
| | | | | | 2331–2440 |
| | | | | | 2728–2834 |
| | | | | | 2920–3028 |
| | | | | | 3370–3514 |
| | | | | | 4153–5236 |
| | | | | | 5877–6744 |
| | | | | | 6813–7124 |
| | | | | | 8441–9280 |
| | | | | | 9527–9953 |
| | | | | | 10394–10536 |
| | | | | | 10945–11362 |
| | | | | | 11763–11843 |
| | | | | | 12653–12953 |
| | | | | | 13970–14183 |
| | | | | | 14223–14726 |
| | | | | | 15929–16299 |
| | | | | | 16328–16751 |
| | | | | | 17791–18093 |
| | | | | | 18095–18712 |
| | | | | | 18754–24628 |
| | | | | | 24879–25426 |
| HTHBG43 | 643 | 919911 | AL139257 | 11420 | 1–286 |
| HTHCA18 | 644 | 908144 | AP002439 | 11421 | 1–1800 |
| HTHCA18 | 644 | 908144 | AP002505 | 11422 | 1–1776 |
| HTHCA18 | 644 | 908144 | AP002439 | 11423 | 1–110 |
| HTHCA18 | 644 | 908144 | AP002505 | 11424 | 1–110 |
| HTJML75 | 648 | 1040047 | AC025036 | 11425 | 1–148 |
| HTJML75 | 648 | 1040047 | AC022232 | 11426 | 1–152 |
| HTJML75 | 648 | 1040047 | AC022231 | 11427 | 1–151 |
| HTJML75 | 648 | 1040047 | AC010694 | 11428 | 1–202 |
| HTJML75 | 648 | 1040047 | AC027300 | 11429 | 1–158 |
| HTJML75 | 648 | 1040047 | AC011953 | 11430 | 1–126 |
| HTJML75 | 648 | 1040047 | AC010694 | 11431 | 1–77 |
| HTLIV19 | 656 | 1046341 | AC055750 | 11432 | 1–964 |
| HTLIV19 | 656 | 1046341 | AC027463 | 11433 | 1–964 |
| HTLIV19 | 656 | 1046341 | AC055750 | 11434 | 1–236 |
| HTLIV19 | 656 | 1046341 | AC027463 | 11435 | 1–236 |
| HTOIZ02 | 664 | 826312 | AC023146 | 11436 | 1–2101 |
| | | | | | 3106–3722 |
| HTOIZ02 | 664 | 826312 | AC023146 | 11437 | 1–278 |
| HTPCS72 | 668 | 854941 | AL008639 | 11438 | 1–106 |
| | | | | | 1457–1595 |
| | | | | | 1666–2484 |
| | | | | | 2910–3006 |
| | | | | | 3705–4147 |
| | | | | | 4768–5141 |
| | | | | | 5304–5536 |
| | | | | | 5746–5874 |
| | | | | | 7114–7241 |
| | | | | | 7468–7711 |
| | | | | | 7963–8746 |
| | | | | | 9438–12408 |
| | | | | | 12884–14976 |
| HTPCS72 | 668 | 854941 | AL008639 | 11439 | 1–720 |
| HAPOB80 | 722 | 1109729 | AC078852 | 11440 | 1–2407 |
| HAPOB80 | 722 | 1109729 | AC022763 | 11441 | 1–1783 |
| HAPOB80 | 722 | 1109729 | AC078852 | 11442 | 1–271 |
| HAPOB80 | 722 | 1109729 | AC022763 | 11443 | 1–212 |
| HFIIZ70 | 737 | 1043350 | AC005005 | 11444 | 1–368 |
| | | | | | 1579–2971 |
| HFIIZ70 | 737 | 1043350 | AC005005 | 11445 | 1–484 |
| | | | | | 517–1142 |
| | | | | | 2842–3176 |
| | | | | | 3376–3493 |
| | | | | | 3575–3740 |
| | | | | | 3873–4227 |
| | | | | | 4728–4935 |
| | | | | | 5074–5351 |
| | | | | | 5446–5564 |
| | | | | | 5772–5960 |
| | | | | | 7287–7627 |
| | | | | | 7721–8097 |
| | | | | | 8218–9325 |
| | | | | | 12098–12161 |
| | | | | | 12780–13266 |
| | | | | | 13482–13666 |
| | | | | | 13748–13817 |
| | | | | | 14445–14519 |
| | | | | | 14595–14928 |
| | | | | | 15658–15754 |
| | | | | | 15848–15923 |
| | | | | | 16016–16112 |
| | | | | | 16512–16660 |
| | | | | | 21313–21448 |
| | | | | | 21710–21870 |
| | | | | | 21899–22470 |
| | | | | | 22634–22787 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 23169–23307 |
| HFOXA73 | 739 | 850699 | AC005866 | 11446 | 1–523 |
| HFOXA73 | 739 | 850699 | AC007618 | 11447 | 1–522 |
| HHENK42 | 744 | 493724 | AC023105 | 11448 | 1–192 |
| | | | | | 355–585 |
| | | | | | 1654–1995 |
| | | | | | 3493–3802 |
| | | | | | 3827–4082 |
| | | | | | 5266–5952 |
| | | | | | 6109–6292 |
| | | | | | 6819–6947 |
| | | | | | 7118–8308 |
| | | | | | 8602–8887 |
| | | | | | 9337–9517 |
| | | | | | 10052–10284 |
| | | | | | 10616–11071 |
| HHENK42 | 744 | 493724 | AC023105 | 11449 | 1–286 |
| HHENK42 | 744 | 493724 | AC023105 | 11450 | 1–754 |
| HLHFR58 | 755 | 919888 | AC020749 | 11451 | 1–1006 |
| HLHFR58 | 755 | 919888 | AC020749 | 11452 | 1–336 |
| HNGAJ15 | 763 | 825397 | AC007491 | 11453 | 1–739 |
| HNGAJ15 | 763 | 825397 | AC025288 | 11454 | 1–739 |
| HTPIH83 | 784 | 919916 | AL158821 | 11455 | 1–1862 |
| | | | | | 1880–3126 |
| HA5BM53 | 806 | 898240 | AC008074 | 11456 | 1–88 |
| | | | | | 305–539 |
| | | | | | 737–973 |
| | | | | | 1093–1180 |
| | | | | | 1791–1973 |
| | | | | | 3574–6888 |
| HA5BM53 | 806 | 898240 | AC008074 | 11457 | 1–186 |
| HACBD86 | 809 | 1113942 | AC008738 | 11458 | 1–138 |
| | | | | | 1790–2389 |
| | | | | | 2399–3518 |
| | | | | | 3754–3889 |
| | | | | | 4140–6179 |
| | | | | | 6463–6642 |
| | | | | | 7618–7771 |
| | | | | | 7958–8056 |
| HADGD17 | 828 | 1063812 | AC011598 | 11459 | 1–1679 |
| HAGBR89 | 840 | 415178 | U95740 | 11460 | 1–648 |
| HAGBR89 | 840 | 415178 | AC020621 | 11461 | 1–648 |
| HAGBR89 | 840 | 415178 | U95740 | 11462 | 1–101 |
| HAGBR89 | 840 | 415178 | U95740 | 11463 | 1–155 |
| HAGBR89 | 840 | 415178 | AC020621 | 11464 | 1–155 |
| HAGBR89 | 840 | 415178 | AC020621 | 11465 | 1–120 |
| HAGDQ47 | 847 | 701967 | AL121755 | 11466 | 1–402 |
| | | | | | 427–1029 |
| | | | | | 1159–1386 |
| | | | | | 1806–3096 |
| HAGDQ47 | 847 | 701967 | AC016073 | 11467 | 1–1289 |
| HAGDQ47 | 847 | 701967 | AL121755 | 11468 | 1–508 |
| HAGDQ47 | 847 | 701967 | AL121755 | 11469 | 1–708 |
| HAGDQ47 | 847 | 701967 | AC016073 | 11470 | 1–708 |
| HAGEB14 | 850 | 1037104 | AC009477 | 11471 | 1–3616 |
| HAGEB14 | 850 | 1037104 | AC009477 | 11472 | 1–1218 |
| | | | | | 1805–2243 |
| | | | | | 2711–2957 |
| | | | | | 3670–3804 |
| | | | | | 5055–5771 |
| | | | | | 5791–6797 |
| | | | | | 6814–6995 |
| | | | | | 7064–7096 |
| HAGEB14 | 850 | 1037104 | AC009477 | 11473 | 1–224 |
| HAMFT10 | 888 | 1090971 | AC004525 | 11474 | 1–913 |
| HAMFT10 | 888 | 1090971 | AC002303 | 11475 | 1–912 |
| HAMFT10 | 888 | 1090971 | AC004525 | 11476 | 1–179 |
| HAMFT10 | 888 | 1090971 | AC002303 | 11477 | 1–179 |
| HANGD45 | 895 | 778064 | AC012031 | 11478 | 1–962 |
| HANGD45 | 895 | 778064 | AC012031 | 11479 | 1–612 |
| HAOST94 | 899 | 1132398 | AL136360 | 11480 | 1–406 |
| | | | | | 480–639 |
| | | | | | 891–976 |
| | | | | | 1731–2105 |
| HAOST94 | 899 | 1132398 | AL136360 | 11481 | 1–544 |
| HAOTS04 | 900 | 1113378 | AC027617 | 11482 | 1–774 |
| HAOTS04 | 900 | 1113378 | AC027617 | 11483 | 1–128 |
| | | | | | 156–198 |
| HAOTS04 | 900 | 1113378 | AC027617 | 11484 | 1–289 |
| HAPOC74 | 906 | 823352 | AC025249 | 11485 | 1–88 |
| | | | | | 2554–3036 |
| | | | | | 4775–4870 |
| | | | | | 5703–5966 |
| | | | | | 6432–6450 |
| | | | | | 6987–7088 |
| | | | | | 7288–9443 |
| HAPOC74 | 906 | 823352 | AC027367 | 11486 | 1–88 |
| | | | | | 2554–3036 |
| | | | | | 4775–4870 |
| | | | | | 5703–5966 |
| | | | | | 6432–6450 |
| | | | | | 6987–7088 |
| | | | | | 7289–9445 |
| HAPSO15 | 919 | 998849 | AL034582 | 11487 | 1–239 |
| | | | | | 1643–1740 |
| | | | | | 6166–6550 |
| | | | | | 7362–7489 |
| | | | | | 12317–12815 |
| | | | | | 12954–13002 |
| | | | | | 14765–15081 |
| | | | | | 17016–17077 |
| | | | | | 17288–17718 |
| | | | | | 18563–18664 |
| | | | | | 18769–18940 |
| | | | | | 20149–20315 |
| | | | | | 20779–22709 |
| | | | | | 23925–26730 |
| HAPSO15 | 919 | 998849 | AL353145 | 11488 | 1–94 |
| | | | | | 1185–1469 |
| | | | | | 1933–3866 |
| HAPSO15 | 919 | 998849 | AL034582 | 11489 | 1–241 |
| HAPSO15 | 919 | 998849 | AL353145 | 11490 | 1–102 |
| HARMB79 | 935 | 1017148 | AC013691 | 11491 | 1–2935 |
| HARMB79 | 935 | 1017148 | AC024602 | 11492 | 1–2935 |
| HARMB79 | 935 | 1017148 | AC016390 | 11493 | 1–2935 |
| HARMB79 | 935 | 1017148 | AC013691 | 11494 | 1–420 |
| HARMB79 | 935 | 1017148 | AC016390 | 11495 | 1–420 |
| HARNB17 | 938 | 997387 | AC012613 | 11496 | 1–1053 |
| HARNB17 | 938 | 997387 | AC025975 | 11497 | 1–43 |
| | | | | | 795–4892 |
| HARNB17 | 938 | 997387 | AC012613 | 11498 | 1–166 |
| HARNB17 | 938 | 997387 | AC025975 | 11499 | 1–166 |
| HARNB92 | 939 | 992934 | AL160011 | 11500 | 1–297 |
| | | | | | 1274–1404 |
| | | | | | 2059–2214 |
| | | | | | 2471–3236 |
| HARNB92 | 939 | 992934 | AL160011 | 11501 | 1–318 |
| HASAW52 | 942 | 1352405 | AC005020 | 11502 | 1–1464 |
| | | | | | 1770–3303 |
| | | | | | 3599–4081 |
| | | | | | 4188–4352 |
| | | | | | 5578–5656 |
| | | | | | 5823–6236 |
| | | | | | 6279–7135 |
| HASAW52 | 942 | 1352405 | AC073063 | 11503 | 1–1112 |
| | | | | | 1419–1901 |
| | | | | | 2009–2172 |
| | | | | | 3398–3476 |
| | | | | | 3643–4056 |
| | | | | | 4099–4955 |
| HASAW52 | 942 | 1352405 | AC005020 | 11504 | 1–409 |
| HBBBC71 | 973 | 908117 | AC006518 | 11505 | 1–1179 |
| HBBBC71 | 973 | 908117 | AC016145 | 11506 | 1–1179 |
| HBCQL32 | 976 | 1134954 | AC069250 | 11507 | 1–461 |
| | | | | | 504–1011 |
| | | | | | 1964–2424 |
| | | | | | 2747–2859 |
| | | | | | 3098–3251 |
| | | | | | 4239–6717 |
| HBCQL32 | 976 | 1134954 | AC069250 | 11508 | 1–418 |
| HBFMC03 | 979 | 1016918 | AC073389 | 11509 | 1–279 |
| | | | | | 1654–1743 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 3751–3941 |
| | | | | | 4388–4489 |
| | | | | | 6957–7211 |
| | | | | | 7624–7793 |
| | | | | | 8100–8235 |
| | | | | | 8893–8993 |
| | | | | | 9534–10048 |
| HBFMC03 | 979 | 1016918 | AC073389 | 11510 | 1–145 |
| HBGNQ12 | 983 | 1189485 | Z97634 | 11511 | 1–1526 |
| | | | | | 1664–1952 |
| | | | | | 2681–2878 |
| | | | | | 3226–3377 |
| | | | | | 3446–3628 |
| | | | | | 3738–3904 |
| | | | | | 3980–4190 |
| | | | | | 4255–4484 |
| | | | | | 4570–4662 |
| | | | | | 4775–5052 |
| | | | | | 5361–5683 |
| | | | | | 5719–6036 |
| | | | | | 6261–6391 |
| | | | | | 6602–6817 |
| | | | | | 6903–7071 |
| HBGNQ12 | 983 | 1189485 | Z97634 | 11512 | 1–407 |
| | | | | | 949–1038 |
| | | | | | 1122–1844 |
| | | | | | 2214–2425 |
| | | | | | 2550–2850 |
| | | | | | 3123–3158 |
| HBHME51 | 984 | 974752 | AC025624 | 11513 | 1–1529 |
| HBHME51 | 984 | 974752 | AC025802 | 11514 | 1–1528 |
| HBHME51 | 984 | 974752 | AC025624 | 11515 | 1–461 |
| HBHME51 | 984 | 974752 | AC025802 | 11516 | 1–461 |
| HBIMT93 | 991 | 1300732 | AC025036 | 11517 | 1–148 |
| HBIMT93 | 991 | 1300732 | AP001451 | 11518 | 1–96 |
| HBIMT93 | 991 | 1300732 | AC048342 | 11519 | 1–130 |
| HBIMT93 | 991 | 1300732 | AC009453 | 11520 | 1–143 |
| HBIMT93 | 991 | 1300732 | AL359092 | 11521 | 1–116 |
| HBIMT93 | 991 | 1300732 | AC022231 | 11522 | 1–151 |
| HBIMT93 | 991 | 1300732 | AC012119 | 11523 | 1–117 |
| HBIMT93 | 991 | 1300732 | AC011953 | 11524 | 1–126 |
| HBIMT93 | 991 | 1300732 | AC048342 | 11525 | 1–118 |
| HBINK72 | 992 | 1001655 | AC025282 | 11526 | 1–1321 |
| | | | | | 1540–1795 |
| | | | | | 2446–2982 |
| | | | | | 3017–3836 |
| | | | | | 3858–4339 |
| | | | | | 4547–4881 |
| | | | | | 5084–5125 |
| | | | | | 5466–6025 |
| | | | | | 6272–6396 |
| | | | | | 6502–7490 |
| | | | | | 7614–8021 |
| | | | | | 8742–8825 |
| | | | | | 10430–12494 |
| | | | | | 13601–14386 |
| | | | | | 15055–15514 |
| | | | | | 15750–15920 |
| | | | | | 18511–18933 |
| HBINK72 | 992 | 1001655 | AC025282 | 11527 | 1–908 |
| HBJKC04 | 1014 | 1093046 | AL139807 | 11528 | 1–1337 |
| HBJKC04 | 1014 | 1093046 | AL139807 | 11529 | 1–487 |
| HBMC150 | 1023 | 668268 | AL139132 | 11530 | 1–890 |
| HBMC150 | 1023 | 668268 | AL359179 | 11531 | 1–891 |
| HBMC150 | 1023 | 668268 | AL139132 | 11532 | 1–155 |
| HBMC150 | 1023 | 668268 | AL359179 | 11533 | 1–155 |
| HBMVI55 | 1039 | 905700 | AC022789 | 11534 | 1–2905 |
| HBMVP04 | 1040 | 812281 | AC006017 | 11535 | 1–75 |
| | | | | | 196–381 |
| | | | | | 445–783 |
| | | | | | 1276–1601 |
| | | | | | 1834–1990 |
| | | | | | 2138–2277 |
| | | | | | 3284–3545 |
| | | | | | 3692–3856 |
| | | | | | 3875–4446 |
| | | | | | 4488–5307 |
| | | | | | 6761–7296 |
| | | | | | 7722–9760 |
| | | | | | 10210–10541 |
| | | | | | 10752–11122 |
| | | | | | 11198–11619 |
| | | | | | 12060–12335 |
| | | | | | 13033–13309 |
| HBMVP04 | 1040 | 812281 | AC006017 | 11536 | 1–310 |
| HBMVP04 | 1040 | 812281 | AC006017 | 11537 | 1–203 |
| HBNBE21 | 1050 | 1352353 | AC025036 | 11538 | 1–148 |
| HBNBE21 | 1050 | 1352353 | AC022232 | 11539 | 1–152 |
| HBNBE21 | 1050 | 1352353 | AP001451 | 11540 | 1–96 |
| HBNBE21 | 1050 | 1352353 | AC010646 | 11541 | 1–147 |
| | | | | | 327–996 |
| | | | | | 1637–1802 |
| | | | | | 1860–2209 |
| | | | | | 2317–3026 |
| HBNBE21 | 1050 | 1352353 | AC048342 | 11542 | 1–130 |
| HBNBE21 | 1050 | 1352353 | AC016327 | 11543 | 1–165 |
| HBNBE21 | 1050 | 1352353 | AC009453 | 11544 | 1–143 |
| HBNBE21 | 1050 | 1352353 | AC025307 | 11545 | 1–175 |
| HBNBE21 | 1050 | 1352353 | AC022231 | 11546 | 1–151 |
| HBNBE21 | 1050 | 1352353 | AC011953 | 11547 | 1–126 |
| HBNBE21 | 1050 | 1352353 | AC009524 | 11548 | 1–151 |
| HBNBE21 | 1050 | 1352353 | AC010646 | 11549 | 1–146 |
| HBNBE21 | 1050 | 1352353 | AC010646 | 11550 | 1–425 |
| | | | | | 665–988 |
| | | | | | 1074–1240 |
| | | | | | 1630–1763 |
| | | | | | 2370–2873 |
| | | | | | 3013–3759 |
| | | | | | 3800–4750 |
| | | | | | 5484–5900 |
| | | | | | 6149–6404 |
| | | | | | 7522–7653 |
| | | | | | 7678–7822 |
| | | | | | 9244–9344 |
| | | | | | 9545–9845 |
| | | | | | 10064–10093 |
| HBNBE21 | 1050 | 1352353 | AC048342 | 11551 | 1–118 |
| HBNBE21 | 1050 | 1352353 | AC016327 | 11552 | 1–195 |
| HBODE48 | 1054 | 1193190 | AC073364 | 11553 | 1–1721 |
| HBODE48 | 1054 | 1193190 | AC011780 | 11554 | 1–1651 |
| HBODE48 | 1054 | 1193190 | AC073364 | 11555 | 1–267 |
| HBODE48 | 1054 | 1193190 | AC011780 | 11556 | 1–267 |
| HBODQ16 | 1055 | 1087346 | AC034198 | 11557 | 1–50 |
| | | | | | 484–630 |
| | | | | | 996–1074 |
| HBODQ16 | 1055 | 1087346 | AC018843 | 11558 | 1–582 |
| | | | | | 1016–1162 |
| | | | | | 1524–2955 |
| | | | | | 4019–4335 |
| | | | | | 4828–5214 |
| | | | | | 5269–5333 |
| | | | | | 5985–6388 |
| | | | | | 8600–8905 |
| | | | | | 10079–10798 |
| | | | | | 11118–11557 |
| | | | | | 11981–12175 |
| | | | | | 12599–12760 |
| | | | | | 16620–16730 |
| | | | | | 17377–17884 |
| | | | | | 18062–18264 |
| | | | | | 18502–18985 |
| | | | | | 19035–19970 |
| HBODQ16 | 1055 | 1087346 | AC018836 | 11559 | 1–582 |
| | | | | | 1016–1162 |
| | | | | | 1524–2955 |
| HBODQ16 | 1055 | 1087346 | AC018843 | 11560 | 1–1581 |
| | | | | | 1718–1832 |
| | | | | | 2383–2885 |
| | | | | | 2889–3163 |
| | | | | | 3380–3618 |
| | | | | | 3781–4195 |
| | | | | | 4259–4601 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 5197–6527 |
| | | | | | 6550–6611 |
| HBODQ16 | 1055 | 1087346 | AC018836 | 11561 | 1–317 |
| HBQAE92 | 1059 | 1119333 | AL355976 | 11562 | 1–467 |
| HBQAE92 | 1059 | 1119333 | AC021696 | 11563 | 1–467 |
| HBQAE92 | 1059 | 1119333 | AL355976 | 11564 | 1–295 |
| HBQAE92 | 1059 | 1119333 | AC021696 | 11565 | 1–279 |
| HBWCB95 | 1063 | 1011489 | AL035469 | 11566 | 1–2796 |
| HBWCB95 | 1063 | 1011489 | AC073053 | 11567 | 1–2796 |
| HBWCB95 | 1063 | 1011489 | AL035469 | 11568 | 1–488 |
| HBWCB95 | 1063 | 1011489 | AC073053 | 11569 | 1–487 |
| HBWCF75 | 1064 | 1300755 | AL358195 | 11570 | 1–1633 |
| HBWCF75 | 1064 | 1300755 | AC011141 | 11571 | 1–1633 |
| HBWCF75 | 1064 | 1300755 | AC013517 | 11572 | 1–1633 |
| HBWCF75 | 1064 | 1300755 | AL358195 | 11573 | 1–433 |
| HBWCF75 | 1064 | 1300755 | AC011141 | 11574 | 1–433 |
| HBWCF75 | 1064 | 1300755 | AC013517 | 11575 | 1–433 |
| HBWCM83 | 1065 | 1041982 | AC017101 | 11576 | 1–3110 |
| HBWCM83 | 1065 | 1041982 | AC017101 | 11577 | 1–557 |
| HBXAB02 | 1066 | 1018820 | AC058783 | 11578 | 1–108 |
| | | | | | 472–583 |
| | | | | | 1659–1759 |
| | | | | | 2301–2392 |
| | | | | | 2712–2979 |
| | | | | | 3109–3313 |
| | | | | | 3496–3686 |
| | | | | | 5094–5501 |
| | | | | | 5898–7517 |
| | | | | | 7923–8386 |
| | | | | | 8828–9312 |
| | | | | | 10777–11598 |
| | | | | | 11688–12958 |
| | | | | | 13563–13696 |
| | | | | | 13923–14488 |
| | | | | | 14952–15025 |
| | | | | | 15654–15816 |
| | | | | | 16107–16496 |
| | | | | | 17141–17423 |
| | | | | | 17436–18535 |
| HBXAB02 | 1066 | 1018820 | AC058783 | 11579 | 1–92 |
| | | | | | 801–1249 |
| | | | | | 1761–1892 |
| | | | | | 3287–3573 |
| | | | | | 4127–4808 |
| | | | | | 5219–5288 |
| HBXAM53 | 1067 | 1002109 | AC005747 | 11580 | 1–6544 |
| HBXAM53 | 1067 | 1002109 | AC026591 | 11581 | 1–3386 |
| HBXAM53 | 1067 | 1002109 | AC005747 | 11582 | 1–355 |
| | | | | | 1343–1704 |
| | | | | | 5018–5322 |
| | | | | | 5737–5837 |
| | | | | | 7291–7368 |
| | | | | | 8895–8994 |
| HBXCL50 | 1069 | 1016032 | AL139396 | 11583 | 1–1459 |
| HBXCL50 | 1069 | 1016032 | AL139396 | 11584 | 1–607 |
| HBXED80 | 1073 | 1352389 | AL158165 | 11585 | 1–143 |
| | | | | | 174–608 |
| | | | | | 894–1331 |
| | | | | | 1742–3705 |
| HBXED80 | 1073 | 1352389 | AL158165 | 11586 | 1–432 |
| HBXED80 | 1073 | 1352389 | AL158165 | 11587 | 1–324 |
| HBXFZ38 | 1078 | 1011284 | AC005479 | 11588 | 1–112 |
| | | | | | 1451–1593 |
| | | | | | 1748–3548 |
| HBZAI19 | 1085 | 1352397 | AP001053 | 11589 | 1–171 |
| | | | | | 414–1007 |
| | | | | | 3047–3199 |
| | | | | | 3245–3336 |
| | | | | | 3661–4006 |
| | | | | | 5369–7237 |
| HBZAI19 | 1085 | 1352397 | AC003656 | 11590 | 1–171 |
| | | | | | 414–1007 |
| | | | | | 3047–3199 |
| | | | | | 3245–3336 |
| | | | | | 3661–4006 |
| | | | | | 5366–7233 |
| HBZAI19 | 1085 | 1352397 | AP001053 | 11591 | 1–212 |
| | | | | | 873–1352 |
| | | | | | 1367–1881 |
| | | | | | 3117–3177 |
| | | | | | 3686–3859 |
| | | | | | 5636–5698 |
| | | | | | 6595–7109 |
| | | | | | 7496–8002 |
| | | | | | 8077–8143 |
| | | | | | 8355–8550 |
| | | | | | 9564–9843 |
| | | | | | 10015–10094 |
| | | | | | 10962–11063 |
| | | | | | 11506–12035 |
| | | | | | 12720–12836 |
| | | | | | 13452–14864 |
| | | | | | 15533–15734 |
| HBZAI19 | 1085 | 1352397 | AC003656 | 11592 | 1–276 |
| HBZAI19 | 1085 | 1352397 | AC003656 | 11593 | 1–141 |
| HCBND16 | 1092 | 1095198 | AL121832 | 11594 | 1–96 |
| | | | | | 730–994 |
| | | | | | 1392–1470 |
| | | | | | 2142–2252 |
| | | | | | 2803–2968 |
| | | | | | 3385–3490 |
| | | | | | 3913–4021 |
| | | | | | 4955–5161 |
| | | | | | 5299–8803 |
| | | | | | 9020–9257 |
| | | | | | 9273–9361 |
| HCBND16 | 1092 | 1095198 | AL121832 | 11595 | 1–683 |
| HCDDP40 | 1102 | 1306585 | AC007785 | 11596 | 1–609 |
| | | | | | 2023–2260 |
| | | | | | 3694–3815 |
| | | | | | 3921–4190 |
| | | | | | 4725–5052 |
| | | | | | 5191–5264 |
| | | | | | 6038–6095 |
| | | | | | 6271–6352 |
| | | | | | 6508–6647 |
| | | | | | 6948–7025 |
| | | | | | 7120–7290 |
| | | | | | 7622–7730 |
| | | | | | 7913–7998 |
| | | | | | 8082–8292 |
| HCDDP40 | 1102 | 1306585 | AC007785 | 11597 | 1–123 |
| HCEBN44 | 1133 | 901918 | AC016943 | 11598 | 1–1810 |
| HCEBN44 | 1133 | 901918 | AC016943 | 11599 | 1–316 |
| HCEBN44 | 1133 | 901918 | AC016943 | 11600 | 1–276 |
| HCEDO84 | 1140 | 651308 | AP000442 | 11601 | 1–110 |
| | | | | | 1671–1833 |
| | | | | | 2258–2541 |
| | | | | | 2656–3699 |
| | | | | | 3792–3942 |
| | | | | | 4306–6277 |
| HCEFI77 | 1149 | 1022457 | AC004780 | 11602 | 1–453 |
| | | | | | 3760–4104 |
| | | | | | 4197–4357 |
| | | | | | 5275–8131 |
| | | | | | 10061–10176 |
| | | | | | 13197–13433 |
| | | | | | 14345–14687 |
| | | | | | 14723–14987 |
| | | | | | 15914–16268 |
| | | | | | 16727–16826 |
| | | | | | 17262–17352 |
| | | | | | 17572–18029 |
| | | | | | 18773–19416 |
| | | | | | 19850–20558 |
| | | | | | 21200–21627 |
| | | | | | 21836–22091 |
| | | | | | 22117–22677 |
| | | | | | 23193–23798 |
| HCEFI77 | 1149 | 1022457 | AC011520 | 11603 | 1–453 |
| | | | | | 3760–4104 |
| | | | | | 4197–4357 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 5275–8131 |
| | | | | | 10061–10176 |
| | | | | | 13197–13433 |
| | | | | | 14345–14687 |
| | | | | | 14730–14987 |
| HCEFI77 | 1149 | 1022457 | AC023970 | 11604 | 1–2858 |
| HCEFI77 | 1149 | 1022457 | AC004780 | 11605 | 1–86 |
| HCEFI77 | 1149 | 1022457 | AC011520 | 11606 | 1–355 |
| HCEFI77 | 1149 | 1022457 | AC023970 | 11607 | 1–345 |
| HCEVB32 | 1169 | 908120 | AP000941 | 11608 | 1–98 |
| | | | | | 376–1438 |
| | | | | | 1651–1770 |
| | | | | | 1941–2117 |
| | | | | | 2258–2360 |
| | | | | | 2495–2584 |
| | | | | | 2702–4066 |
| HCEVB32 | 1169 | 908120 | AP000830 | 11609 | 1–98 |
| | | | | | 376–1438 |
| | | | | | 1651–1770 |
| | | | | | 1941–2117 |
| | | | | | 2257–2359 |
| | | | | | 2494–2583 |
| | | | | | 2701–4064 |
| HCEVB32 | 1169 | 908120 | AP001262 | 11610 | 1–97 |
| | | | | | 375–1437 |
| | | | | | 1652–1771 |
| | | | | | 1942–2118 |
| | | | | | 2258–2360 |
| | | | | | 2497–2584 |
| | | | | | 2702–3907 |
| HCEVB32 | 1169 | 908120 | AP000941 | 11611 | 1–242 |
| HCEVB32 | 1169 | 908120 | AP000830 | 11612 | 1–127 |
| HCGBE81 | 1201 | 1033701 | AC023774 | 11613 | 1–2711 |
| HCGBE81 | 1201 | 1033701 | AC009783 | 11614 | 1–4398 |
| HCGBE81 | 1201 | 1033701 | AC023774 | 11615 | 1–862 |
| HCGBE81 | 1201 | 1033701 | AC009783 | 11616 | 1–3878 |
| HCGBE81 | 1201 | 1033701 | AC009783 | 11617 | 1–862 |
| HCHAR90 | 1205 | 1132560 | AC068117 | 11618 | 1–1185 |
| HCHAR90 | 1205 | 1132560 | AC025486 | 11619 | 1–636 |
| HCHPU32 | 1210 | 1161285 | AC004851 | 11620 | 1–151 |
| | | | | | 1238–1932 |
| | | | | | 3038–3128 |
| | | | | | 5287–5387 |
| | | | | | 5902–5984 |
| | | | | | 6594–6870 |
| | | | | | 7064–7250 |
| | | | | | 7323–7404 |
| | | | | | 8002–8339 |
| | | | | | 11564–11749 |
| | | | | | 12077–12271 |
| | | | | | 13077–15873 |
| | | | | | 16945–16964 |
| | | | | | 17993–18105 |
| | | | | | 19966–20005 |
| | | | | | 20508–20588 |
| | | | | | 21707–21799 |
| | | | | | 22024–22123 |
| | | | | | 25552–25713 |
| | | | | | 26586–26632 |
| | | | | | 27329–27482 |
| | | | | | 27574–27639 |
| | | | | | 27780–28031 |
| | | | | | 28933–29119 |
| HCHPU32 | 1210 | 1161285 | AC004851 | 11621 | 1–206 |
| HCHPU32 | 1210 | 1161285 | AC004851 | 11622 | 1–145 |
| HCLBW50 | 1211 | 1032600 | AC004551 | 11623 | 1–65 |
| | | | | | 1699–1790 |
| | | | | | 3052–3273 |
| | | | | | 4672–4864 |
| | | | | | 5803–6209 |
| HCLBW50 | 1211 | 1032600 | AC004551 | 11624 | 1–2640 |
| | | | | | 3328–3654 |
| | | | | | 3780–4021 |
| | | | | | 5124–5312 |
| | | | | | 6503–6791 |
| | | | | | 6816–7381 |
| | | | | | 8621–8793 |
| | | | | | 8993–9336 |
| | | | | | 9851–10016 |
| | | | | | 13315–13460 |
| | | | | | 13968–14208 |
| HCLCJ15 | 1212 | 1041761 | AC011509 | 11625 | 1–84 |
| HCLCJ15 | 1212 | 1041761 | AC026537 | 11626 | 1–132 |
| HCLCJ15 | 1212 | 1041761 | AC027264 | 11627 | 1–147 |
| HCLCJ15 | 1212 | 1041761 | AC069362 | 11628 | 1–131 |
| HCLCJ15 | 1212 | 1041761 | AC055805 | 11629 | 1–143 |
| HCLCJ15 | 1212 | 1041761 | AC012110 | 11630 | 1–98 |
| HCLCJ15 | 1212 | 1041761 | AL162727 | 11631 | 1–135 |
| HCLCJ15 | 1212 | 1041761 | AL353663 | 11632 | 1–141 |
| HCLCJ15 | 1212 | 1041761 | AC031987 | 11633 | 1–125 |
| HCLCJ15 | 1212 | 1041761 | AC022922 | 11634 | 1–105 |
| HCLCJ15 | 1212 | 1041761 | AC009899 | 11635 | 1–175 |
| HCLCJ15 | 1212 | 1041761 | AC009097 | 11636 | 1–101 |
| HCLCJ15 | 1212 | 1041761 | AC025181 | 11637 | 1–159 |
| HCLCJ15 | 1212 | 1041761 | AC025987 | 11638 | 1–176 |
| HCLCJ15 | 1212 | 1041761 | AC027772 | 11639 | 1–189 |
| HCLCJ15 | 1212 | 1041761 | AC016797 | 11640 | 1–116 |
| HCLCJ15 | 1212 | 1041761 | AC027584 | 11641 | 1–162 |
| HCLCJ15 | 1212 | 1041761 | AC008470 | 11642 | 1–129 |
| HCLCJ15 | 1212 | 1041761 | AC023309 | 11643 | 1–193 |
| HCLCJ15 | 1212 | 1041761 | AC073446 | 11644 | 1–140 |
| HCLCJ15 | 1212 | 1041761 | AC024475 | 11645 | 1–187 |
| HCLCJ15 | 1212 | 1041761 | AC026556 | 11646 | 1–114 |
| HCLCJ15 | 1212 | 1041761 | AC009858 | 11647 | 1–39 |
| HCLCJ15 | 1212 | 1041761 | AL161905 | 11648 | 1–114 |
| HCLCJ15 | 1212 | 1041761 | AC068682 | 11649 | 1–153 |
| HCLCJ15 | 1212 | 1041761 | AC034137 | 11650 | 1–202 |
| HCLCJ15 | 1212 | 1041761 | AC026107 | 11651 | 1–275 |
| HCLCJ15 | 1212 | 1041761 | AC022021 | 11652 | 1–111 |
| HCLCJ15 | 1212 | 1041761 | AC027544 | 11653 | 1–158 |
| HCLCJ15 | 1212 | 1041761 | AC011036 | 11654 | 1–193 |
| HCLCJ15 | 1212 | 1041761 | AC016439 | 11655 | 1–164 |
| HCLCJ15 | 1212 | 1041761 | AC027095 | 11656 | 1–93 |
| HCLCJ15 | 1212 | 1041761 | AC025975 | 11657 | 1–136 |
| HCLCJ15 | 1212 | 1041761 | AL353577 | 11658 | 1–279 |
| HCLCJ15 | 1212 | 1041761 | AC016042 | 11659 | 1–138 |
| HCLCJ15 | 1212 | 1041761 | AL353659 | 11660 | 1–202 |
| HCLCJ15 | 1212 | 1041761 | AC022795 | 11661 | 1–300 |
| HCLCJ15 | 1212 | 1041761 | AC016142 | 11662 | 1–150 |
| HCLCJ15 | 1212 | 1041761 | AL355975 | 11663 | 1–322 |
| HCLCJ15 | 1212 | 1041761 | AC023864 | 11664 | 1–142 |
| HCLCJ15 | 1212 | 1041761 | AF287957 | 11665 | 1–122 |
| HCLCJ15 | 1212 | 1041761 | AC073219 | 11666 | 1–123 |
| HCLCJ15 | 1212 | 1041761 | AL139131 | 11667 | 1–214 |
| HCLCJ15 | 1212 | 1041761 | AC004803 | 11668 | 1–154 |
| HCLCJ15 | 1212 | 1041761 | AL159994 | 11669 | 1–1632 |
| HCLCJ15 | 1212 | 1041761 | AC012110 | 11670 | 1–1782 |
| | | | | | 4643–4802 |
| HCLCJ15 | 1212 | 1041761 | AC022922 | 11671 | 1–160 |
| HCLCJ15 | 1212 | 1041761 | AC025987 | 11672 | 1–332 |
| | | | | | 2668–2705 |
| HCLCJ15 | 1212 | 1041761 | AC027584 | 11673 | 1–368 |
| HCLCJ15 | 1212 | 1041761 | AC073446 | 11674 | 1–52 |
| | | | | | 2626–2925 |
| HCLCJ15 | 1212 | 1041761 | AC009858 | 11675 | 1–212 |
| HCLCJ15 | 1212 | 1041761 | AC023864 | 11676 | 1–1485 |
| | | | | | 1590–4704 |
| HCLCJ15 | 1212 | 1041761 | AF287957 | 11677 | 1–1090 |
| HCLCJ15 | 1212 | 1041761 | AL159994 | 11678 | 1–654 |
| HCMSC92 | 1214 | 1007977 | AC009116 | 11679 | 1–85 |
| | | | | | 2799–2900 |
| | | | | | 3898–4654 |
| | | | | | 7580–7809 |
| | | | | | 8000–8171 |
| | | | | | 12357–12499 |
| | | | | | 14986–15053 |
| | | | | | 18180–18615 |
| | | | | | 18734–19234 |
| | | | | | 19333–19776 |
| HCMSC92 | 1214 | 1007977 | AC009116 | 11680 | 1–166 |
| | | | | | 585–642 |
| HCOMM91 | 1226 | 1034600 | AC010530 | 11681 | 1–154 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 206–437 |
| | | | | | 1339–1505 |
| | | | | | 1831–3087 |
| | | | | | 3185–4611 |
| | | | | | 4749–5051 |
| | | | | | 5405–5493 |
| HCOMM91 | 1226 | 1034600 | AC009095 | 11682 | 1–378 |
| | | | | | 466–660 |
| | | | | | 1562–1741 |
| | | | | | 2054–3311 |
| | | | | | 3409–4835 |
| | | | | | 4973–5275 |
| | | | | | 5629–5717 |
| HCOMM91 | 1226 | 1034600 | AC010530 | 11683 | 1–909 |
| | | | | | 1015–1114 |
| | | | | | 1197–1346 |
| | | | | | 1392–1441 |
| | | | | | 1549–1579 |
| | | | | | 1729–1884 |
| | | | | | 1994–2092 |
| | | | | | 2171–2257 |
| | | | | | 2442–2839 |
| | | | | | 2882–3411 |
| | | | | | 3494–4387 |
| | | | | | 4512–5270 |
| | | | | | 5911–6035 |
| | | | | | 6121–6479 |
| | | | | | 6562–6668 |
| HCOMM91 | 1226 | 1034600 | AC009095 | 11684 | 1–913 |
| | | | | | 1015–1114 |
| | | | | | 1197–1346 |
| | | | | | 1395–1444 |
| | | | | | 1552–1582 |
| | | | | | 1732–1887 |
| | | | | | 1997–2095 |
| | | | | | 2174–2260 |
| | | | | | 2445–2842 |
| | | | | | 2885–3413 |
| | | | | | 3496–4389 |
| | | | | | 4514–5272 |
| | | | | | 5913–6037 |
| | | | | | 6123–6481 |
| | | | | | 6564–6670 |
| HCRAI47 | 1234 | 862235 | AC005263 | 11685 | 1–803 |
| | | | | | 896–964 |
| | | | | | 2069–3576 |
| | | | | | 4148–7249 |
| | | | | | 8340–8634 |
| | | | | | 8825–8987 |
| | | | | | 9596–10544 |
| | | | | | 11275–11338 |
| | | | | | 13240–13327 |
| HCRAI47 | 1234 | 862235 | AC005263 | 11686 | 1–128 |
| HCRAI47 | 1234 | 862235 | AC005263 | 11687 | 1–388 |
| HCRNC80 | 1239 | 975367 | AC015802 | 11688 | 1–895 |
| | | | | | 932–2404 |
| | | | | | 2584–4300 |
| | | | | | 4400–4642 |
| | | | | | 6782–6891 |
| | | | | | 7541–8404 |
| | | | | | 8903–9373 |
| | | | | | 9676–10057 |
| | | | | | 10448–10763 |
| | | | | | 11810–12089 |
| | | | | | 12750–13250 |
| | | | | | 14020–14166 |
| | | | | | 14469–14916 |
| | | | | | 14991–15071 |
| | | | | | 16171–16907 |
| | | | | | 17152–17248 |
| | | | | | 17888–18001 |
| | | | | | 18808–18905 |
| | | | | | 19540–20043 |
| | | | | | 20149–20298 |
| | | | | | 20785–20945 |
| | | | | | 21564–21885 |
| | | | | | 22131–22334 |
| | | | | | 22407–22617 |
| | | | | | 23638–23744 |
| | | | | | 24182–24238 |
| | | | | | 24394–24589 |
| | | | | | 24729–25108 |
| | | | | | 25245–25807 |
| | | | | | 26278–26391 |
| | | | | | 26613–26688 |
| | | | | | 26883–27046 |
| | | | | | 27275–27372 |
| | | | | | 27503–27579 |
| | | | | | 27670–27768 |
| | | | | | 28028–28730 |
| | | | | | 29304–30527 |
| HCRNC80 | 1239 | 975367 | AC016385 | 11689 | 1–57 |
| | | | | | 213–408 |
| | | | | | 548–927 |
| | | | | | 1064–1627 |
| | | | | | 2098–2211 |
| | | | | | 2433–2508 |
| | | | | | 2703–2866 |
| | | | | | 3095–3192 |
| | | | | | 3323–3399 |
| | | | | | 3490–3588 |
| | | | | | 3848–4550 |
| | | | | | 5124–6347 |
| HCRNC80 | 1239 | 975367 | AC015802 | 11690 | 1–451 |
| | | | | | 785–942 |
| | | | | | 1204–1444 |
| | | | | | 2389–2565 |
| HCRNC80 | 1239 | 975367 | AC016385 | 11691 | 1–451 |
| | | | | | 785–942 |
| | | | | | 1204–1444 |
| | | | | | 2389–2565 |
| HCRNF14 | 1240 | 1107561 | AC025343 | 11692 | 1–140 |
| | | | | | 302–699 |
| | | | | | 812–1108 |
| | | | | | 1640–1684 |
| | | | | | 1888–2224 |
| | | | | | 2528–2771 |
| | | | | | 3282–3409 |
| | | | | | 3534–3585 |
| | | | | | 3668–3744 |
| | | | | | 3915–4023 |
| | | | | | 4038–4444 |
| | | | | | 4524–5114 |
| | | | | | 5209–5333 |
| | | | | | 5430–5566 |
| | | | | | 5654–5698 |
| | | | | | 6066–6115 |
| | | | | | 6274–6392 |
| | | | | | 6474–6617 |
| | | | | | 7064–7675 |
| HCRNF14 | 1240 | 1107561 | AC008760 | 11693 | 1–140 |
| | | | | | 302–699 |
| | | | | | 812–1108 |
| | | | | | 1644–1688 |
| | | | | | 1892–2228 |
| | | | | | 3289–3416 |
| | | | | | 3541–3592 |
| | | | | | 3675–3751 |
| | | | | | 3922–4030 |
| | | | | | 4045–4451 |
| | | | | | 4531–5121 |
| | | | | | 5216–5340 |
| | | | | | 5437–5573 |
| | | | | | 5661–5705 |
| | | | | | 6073–6122 |
| | | | | | 6282–6398 |
| | | | | | 6482–6625 |
| | | | | | 7073–7684 |
| HCRPV17 | 1243 | 1031522 | AF196972 | 11694 | 1–74 |
| | | | | | 391–524 |
| | | | | | 1481–1536 |
| | | | | | 1623–1699 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 2092–2448 |
| | | | | | 2537–2611 |
| | | | | | 3085–3179 |
| | | | | | 3315–3395 |
| | | | | | 6429–6514 |
| | | | | | 6997–7407 |
| | | | | | 7611–7693 |
| | | | | | 8316–8774 |
| | | | | | 9534–9680 |
| | | | | | 9770–9875 |
| | | | | | 10373–10876 |
| HCRPV17 | 1243 | 1031522 | AF196972 | 11695 | 1–742 |
| HCUDW10 | 1256 | 853991 | AC016754 | 11696 | 1–128 |
| | | | | | 2221–2363 |
| | | | | | 3554–4516 |
| | | | | | 4597–4698 |
| | | | | | 6049–6881 |
| HCUDW10 | 1256 | 853991 | AC016754 | 11697 | 1–247 |
| HCUGC55 | 1261 | 1001608 | AC067748 | 11698 | 1–565 |
| HCUGC55 | 1261 | 1001608 | AC024073 | 11699 | 1–565 |
| HCUGC55 | 1261 | 1001608 | AC022400 | 11700 | 1–565 |
| HCUGC55 | 1261 | 1001608 | AC037447 | 11701 | 1–565 |
| HCUGC55 | 1261 | 1001608 | AC067748 | 11702 | 1–459 |
| HCUGC55 | 1261 | 1001608 | AC024073 | 11703 | 1–319 |
| HCUGC55 | 1261 | 1001608 | AC024073 | 11704 | 1–459 |
| HCUGC55 | 1261 | 1001608 | AC022400 | 11705 | 1–460 |
| HCUGC55 | 1261 | 1001608 | AC022400 | 11706 | 1–485 |
| | | | | | 735–776 |
| HCUGC55 | 1261 | 1001608 | AC037447 | 11707 | 1–460 |
| HCUGC55 | 1261 | 1001608 | AC037447 | 11708 | 1–490 |
| | | | | | 735–776 |
| HCUHQ40 | 1266 | 1352422 | AC026472 | 11709 | 1–1708 |
| | | | | | 1773–1901 |
| | | | | | 2933–3018 |
| | | | | | 3110–3300 |
| | | | | | 3359–4031 |
| | | | | | 4088–4276 |
| | | | | | 4296–5408 |
| | | | | | 5428–5569 |
| | | | | | 6258–6379 |
| | | | | | 6777–7199 |
| | | | | | 8369–8887 |
| | | | | | 9764–9883 |
| HCUHQ40 | 1266 | 1352422 | AC025289 | 11710 | 1–5838 |
| | | | | | 8668–8756 |
| | | | | | 10576–10753 |
| | | | | | 10916–11341 |
| | | | | | 11404–12160 |
| | | | | | 13265–14382 |
| | | | | | 14933–15112 |
| | | | | | 15193–15301 |
| | | | | | 17008–17282 |
| | | | | | 17314–22204 |
| | | | | | 22242–22584 |
| | | | | | 24485–24777 |
| | | | | | 25510–25629 |
| | | | | | 26506–27024 |
| | | | | | 28194–28616 |
| | | | | | 29014–29135 |
| | | | | | 29722–29959 |
| | | | | | 29985–31097 |
| | | | | | 31117–31305 |
| | | | | | 31362–32034 |
| | | | | | 32093–32283 |
| | | | | | 32375–32460 |
| | | | | | 33492–33620 |
| | | | | | 33685–35392 |
| | | | | | 36712–37666 |
| | | | | | 37935–38081 |
| | | | | | 38641–38676 |
| | | | | | 38903–38998 |
| | | | | | 40715–40820 |
| | | | | | 41562–41928 |
| | | | | | 42200–42726 |
| | | | | | 42883–43189 |
| | | | | | 43675–44260 |
| | | | | | 44379–44759 |
| | | | | | 44772–45099 |
| | | | | | 45150–45767 |
| | | | | | 48510–50196 |
| HCUHQ40 | 1266 | 1352422 | AC026472 | 11711 | 1–293 |
| HCUHQ40 | 1266 | 1352422 | AC025289 | 11712 | 1–571 |
| HCWBP34 | 1274 | 1007830 | AC027529 | 11713 | 1–211 |
| | | | | | 656–771 |
| HCWBP34 | 1274 | 1007830 | AL157366 | 11714 | 1–140 |
| HCWBP34 | 1274 | 1007830 | AC034240 | 11715 | 1–2029 |
| HCWBP34 | 1274 | 1007830 | AL354924 | 11716 | 1–182 |
| HCWBP34 | 1274 | 1007830 | AC017039 | 11717 | 1–2031 |
| HCWBP34 | 1274 | 1007830 | AC055119 | 11718 | 1–320 |
| HCWBP34 | 1274 | 1007830 | AL357125 | 11719 | 1–278 |
| HCWBP34 | 1274 | 1007830 | AC017039 | 11720 | 1–111 |
| HCWFT79 | 1284 | 996375 | AL359382 | 11721 | 1–2664 |
| HCWFU77 | 1285 | 1001004 | AC024555 | 11722 | 1–1180 |
| | | | | | 1891–2295 |
| | | | | | 2945–3636 |
| | | | | | 4834–5215 |
| | | | | | 5404–5600 |
| | | | | | 5882–6002 |
| | | | | | 7584–7684 |
| | | | | | 9738–9885 |
| | | | | | 10543–10662 |
| | | | | | 11124–11266 |
| | | | | | 11600–11776 |
| | | | | | 14360–14821 |
| HCWFU77 | 1285 | 1001004 | AC024555 | 11723 | 1–114 |
| HCWFZ59 | 1287 | 1001637 | AC011554 | 11724 | 1–2981 |
| HCWFZ59 | 1287 | 1001637 | AC011554 | 11725 | 1–106 |
| HCWFZ59 | 1287 | 1001637 | AC011554 | 11726 | 1–99 |
| | | | | | 1915–2018 |
| | | | | | 3173–3680 |
| | | | | | 4590–4661 |
| HCWHV88 | 1291 | 1027324 | AP000481 | 11727 | 1–2010 |
| HCWHV88 | 1291 | 1027324 | AP000671 | 11728 | 1–2007 |
| HCWHV88 | 1291 | 1027324 | AC019220 | 11729 | 1–2005 |
| HCWHV88 | 1291 | 1027324 | AP001385 | 11730 | 1–2005 |
| HCWHV88 | 1291 | 1027324 | AP000481 | 11731 | 1–323 |
| HCWHV88 | 1291 | 1027324 | AP000671 | 11732 | 1–987 |
| | | | | | 1154–2654 |
| HCWHV88 | 1291 | 1027324 | AC019220 | 11733 | 1–1107 |
| | | | | | 1275–2772 |
| HCWHV88 | 1291 | 1027324 | AC019220 | 11734 | 1–323 |
| HCWHV88 | 1291 | 1027324 | AP001385 | 11735 | 1–1470 |
| | | | | | 1637–3136 |
| HDABU01 | 1305 | 1164039 | Z93016 | 11736 | 1–4307 |
| HDABU01 | 1305 | 1164039 | Z93016 | 11737 | 1–552 |
| HDABU01 | 1305 | 1164039 | Z93016 | 11738 | 1–481 |
| HDDMW90 | 1307 | 1145707 | AC020578 | 11739 | 1–429 |
| | | | | | 1094–1258 |
| | | | | | 1389–1594 |
| | | | | | 2058–2998 |
| | | | | | 3117–3400 |
| | | | | | 4156–4437 |
| | | | | | 5028–5224 |
| | | | | | 6162–6316 |
| | | | | | 9343–9463 |
| | | | | | 10746–11195 |
| | | | | | 11442–11993 |
| | | | | | 13524–14380 |
| | | | | | 14802–14916 |
| | | | | | 16574–16679 |
| | | | | | 16844–18286 |
| HDDMW90 | 1307 | 1145707 | AC019254 | 11740 | 1–430 |
| | | | | | 1094–1258 |
| | | | | | 1390–1595 |
| | | | | | 2059–2999 |
| | | | | | 3118–3401 |
| | | | | | 4157–4438 |
| | | | | | 5029–5225 |
| | | | | | 6163–6317 |
| | | | | | 9344–9464 |
| | | | | | 10747–11196 |
| | | | | | 11443–11994 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 13525–14381 |
| | | | | | 14803–14917 |
| | | | | | 16575–16680 |
| | | | | | 16845–18287 |
| HDDMW90 | 1307 | 1145707 | AC020578 | 11741 | 1–1086 |
| HDDMW90 | 1307 | 1145707 | AC019254 | 11742 | 1–1086 |
| HDDMW90 | 1307 | 1145707 | AC019254 | 11743 | 1–421 |
| HDPAP35 | 1314 | 1014385 | AL162253 | 11744 | 1–46 |
| | | | | | 1212–1379 |
| | | | | | 1730–1813 |
| | | | | | 5551–5617 |
| | | | | | 6531–6874 |
| | | | | | 6881–7463 |
| | | | | | 12287–12691 |
| | | | | | 13872–14366 |
| | | | | | 14949–15060 |
| | | | | | 16220–16281 |
| | | | | | 16685–16740 |
| | | | | | 16956–20020 |
| HDPAP35 | 1314 | 1014385 | AL162253 | 11745 | 1–4932 |
| HDPCL05 | 1324 | 1186034 | AC008750 | 11746 | 1–137 |
| | | | | | 215–1018 |
| | | | | | 1327–1783 |
| | | | | | 2049–2857 |
| | | | | | 3151–3259 |
| | | | | | 3858–3970 |
| | | | | | 4049–4508 |
| | | | | | 5630–5909 |
| | | | | | 6004–7661 |
| HDPCL05 | 1324 | 1186034 | AC008750 | 11747 | 1–545 |
| HDPDI45 | 1327 | 979731 | AF205589 | 11748 | 1–504 |
| | | | | | 619–861 |
| | | | | | 964–2152 |
| | | | | | 2192–2722 |
| HDPDI45 | 1327 | 979731 | AF205589 | 11749 | 1–788 |
| | | | | | 873–1292 |
| | | | | | 1387–3089 |
| HDPDI45 | 1327 | 979731 | AF205589 | 11750 | 1–408 |
| HDPRJ60 | 1355 | 1159861 | AC005786 | 11751 | 1–30 |
| | | | | | 312–1713 |
| | | | | | 1738–5914 |
| | | | | | 6294–6400 |
| | | | | | 6543–6705 |
| | | | | | 7618–8992 |
| | | | | | 9073–9198 |
| | | | | | 9347–10283 |
| | | | | | 10324–10458 |
| | | | | | 10940–11440 |
| | | | | | 11585–12104 |
| | | | | | 12376–12654 |
| | | | | | 12787–12886 |
| | | | | | 12967–13069 |
| | | | | | 13364–13553 |
| | | | | | 13642–13789 |
| | | | | | 15077–15194 |
| | | | | | 15889–16387 |
| | | | | | 16501–16714 |
| | | | | | 18397–18862 |
| | | | | | 19033–19272 |
| | | | | | 19377–19480 |
| | | | | | 19891–20605 |
| | | | | | 22624–23090 |
| HDPSB01 | 1359 | 1229541 | AC018470 | 11752 | 1–234 |
| | | | | | 2643–2811 |
| | | | | | 4131–4286 |
| | | | | | 6563–6658 |
| | | | | | 7296–7414 |
| | | | | | 8679–9296 |
| | | | | | 9645–10062 |
| | | | | | 11527–11608 |
| HDPSB01 | 1359 | 1229541 | AC018470 | 11753 | 1–312 |
| HDPSB01 | 1359 | 1229541 | AC018470 | 11754 | 1–188 |
| HDPTW24 | 1363 | 843591 | AL390738 | 11755 | 1–77 |
| HDPTW24 | 1363 | 843591 | AC012156 | 11756 | 1–204 |
| HDPTW24 | 1363 | 843591 | AC006994 | 11757 | 1–1289 |
| HDPTW24 | 1363 | 843591 | AP001124 | 11758 | 1–256 |
| HDPTW24 | 1363 | 843591 | AC013558 | 11759 | 1–247 |
| HDPTW24 | 1363 | 843591 | AP002354 | 11760 | 1–157 |
| HDPTW24 | 1363 | 843591 | AP002353 | 11761 | 1–252 |
| HDPTW24 | 1363 | 843591 | AC015810 | 11762 | 1–309 |
| HDPTW24 | 1363 | 843591 | AP001840 | 11763 | 1–310 |
| HDPTW24 | 1363 | 843591 | AC008747 | 11764 | 1–94 |
| | | | | | 1121–1221 |
| | | | | | 1568–1667 |
| | | | | | 3326–3463 |
| | | | | | 3964–4707 |
| | | | | | 5167–5726 |
| | | | | | 7333–7855 |
| | | | | | 8552–8723 |
| | | | | | 8880–8937 |
| | | | | | 9052–9217 |
| | | | | | 9328–9463 |
| HDPTW24 | 1363 | 843591 | AC069581 | 11765 | 1–250 |
| HDPTW24 | 1363 | 843591 | AC034141 | 11766 | 1–262 |
| HDPTW24 | 1363 | 843591 | AC023137 | 11767 | 1–297 |
| HDPTW24 | 1363 | 843591 | AP001803 | 11768 | 1–306 |
| HDPTW24 | 1363 | 843591 | AC078843 | 11769 | 1–314 |
| HDPTW24 | 1363 | 843591 | AC021438 | 11770 | 1–253 |
| HDPTW24 | 1363 | 843591 | AP000893 | 11771 | 1–303 |
| HDPTW24 | 1363 | 843591 | AC016358 | 11772 | 1–244 |
| HDPTW24 | 1363 | 843591 | AL359535 | 11773 | 1–253 |
| HDPTW24 | 1363 | 843591 | AP001356 | 11774 | 1–306 |
| HDPTW24 | 1363 | 843591 | AC060795 | 11775 | 1–257 |
| HDPTW24 | 1363 | 843591 | AC074255 | 11776 | 1–254 |
| HDPTW24 | 1363 | 843591 | AP000826 | 11777 | 1–304 |
| HDPTW24 | 1363 | 843591 | AP001167 | 11778 | 1–201 |
| HDPTW24 | 1363 | 843591 | AC067881 | 11779 | 1–257 |
| HDPTW24 | 1363 | 843591 | AP000881 | 11780 | 1–303 |
| HDPTW24 | 1363 | 843591 | AL161632 | 11781 | 1–308 |
| HDPTW24 | 1363 | 843591 | AC040934 | 11782 | 1–307 |
| HDPTW24 | 1363 | 843591 | AC009576 | 11783 | 1–258 |
| HDPTW24 | 1363 | 843591 | AL161619 | 11784 | 1–262 |
| HDPTW24 | 1363 | 843591 | AP001377 | 11785 | 1–257 |
| HDPTW24 | 1363 | 843591 | AC025054 | 11786 | 1–301 |
| HDPTW24 | 1363 | 843591 | AC027146 | 11787 | 1–301 |
| HDPTW24 | 1363 | 843591 | AP000626 | 11788 | 1–277 |
| HDPTW24 | 1363 | 843591 | AP001024 | 11789 | 1–259 |
| HDPTW24 | 1363 | 843591 | AL355821 | 11790 | 1–135 |
| HDPTW24 | 1363 | 843591 | AP001498 | 11791 | 1–252 |
| HDPTW24 | 1363 | 843591 | AL357141 | 11792 | 1–306 |
| HDPTW24 | 1363 | 843591 | AP001281 | 11793 | 1–314 |
| HDPTW24 | 1363 | 843591 | AP002344 | 11794 | 1–311 |
| HDPTW24 | 1363 | 843591 | AP001806 | 11795 | 1–256 |
| HDPTW24 | 1363 | 843591 | AL390738 | 11796 | 1–83 |
| | | | | | 96–126 |
| HDPTW24 | 1363 | 843591 | AL390738 | 11797 | 1–76 |
| HDPTW24 | 1363 | 843591 | AC006994 | 11798 | 1–295 |
| HDPTW24 | 1363 | 843591 | AP000881 | 11799 | 1–49 |
| HDPTW24 | 1363 | 843591 | AC040934 | 11800 | 1–915 |
| HDPTW24 | 1363 | 843591 | AC027146 | 11801 | 1–160 |
| HDPTW65 | 1364 | 912262 | AL138777 | 11802 | 1–2089 |
| HDPTW65 | 1364 | 912262 | AL138777 | 11803 | 1–327 |
| | | | | | 431–662 |
| HDPWP69 | 1366 | 1305302 | AC010206 | 11804 | 1–72 |
| | | | | | 1626–1985 |
| | | | | | 2078–2521 |
| | | | | | 2591–2732 |
| | | | | | 3106–4367 |
| | | | | | 4444–4719 |
| | | | | | 4774–8347 |
| | | | | | 8369–9220 |
| | | | | | 9403–9577 |
| | | | | | 10168–10549 |
| | | | | | 10809–11267 |
| | | | | | 14856–15024 |
| HDPWP69 | 1366 | 1305302 | AC008119 | 11805 | 1–72 |
| | | | | | 1626–1985 |
| | | | | | 2078–2521 |
| | | | | | 2591–2732 |
| | | | | | 3106–4367 |
| | | | | | 4444–4719 |
| | | | | | 4774–8346 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 8369–9220 |
| | | | | | 9403–9577 |
| | | | | | 10168–10549 |
| | | | | | 10809–11267 |
| | | | | | 13168–13203 |
| | | | | | 13265–13577 |
| | | | | | 14854–15024 |
| | | | | | 15351–16264 |
| | | | | | 16931–17918 |
| | | | | | 18542–18747 |
| | | | | | 20069–20284 |
| | | | | | 21223–21283 |
| | | | | | 21417–21498 |
| | | | | | 21578–22111 |
| | | | | | 22199–22914 |
| | | | | | 23643–23801 |
| | | | | | 24352–24760 |
| | | | | | 26728–27314 |
| | | | | | 27581–28667 |
| | | | | | 28874–29575 |
| | | | | | 29850–30034 |
| | | | | | 31871–32702 |
| | | | | | 33799–33927 |
| HDPWP69 | 1366 | 1305302 | AC008119 | 11806 | 1–254 |
| HDPXL05 | 1367 | 1084839 | AL031657 | 11807 | 1–2363 |
| HDPXL05 | 1367 | 1084839 | AL031657 | 11808 | 1–265 |
| HDPXY88 | 1370 | 1124960 | AC006064 | 11809 | 1–78 |
| | | | | | 361–417 |
| | | | | | 561–808 |
| | | | | | 913–1097 |
| | | | | | 1394–1530 |
| | | | | | 2288–2401 |
| | | | | | 2442–2576 |
| | | | | | 4543–4680 |
| | | | | | 4750–4873 |
| | | | | | 5056–5206 |
| | | | | | 7114–7312 |
| | | | | | 7649–7791 |
| | | | | | 7863–7971 |
| | | | | | 8065–8251 |
| | | | | | 9179–9471 |
| | | | | | 9659–10154 |
| | | | | | 11266–11397 |
| | | | | | 12082–12334 |
| | | | | | 13109–13288 |
| | | | | | 13545–13632 |
| | | | | | 14118–14386 |
| | | | | | 14850–14950 |
| | | | | | 15869–16002 |
| | | | | | 16353–16486 |
| | | | | | 16571–16658 |
| | | | | | 16732–16901 |
| | | | | | 17177–17349 |
| | | | | | 18061–18178 |
| | | | | | 18253–18377 |
| | | | | | 18457–18615 |
| | | | | | 18958–19152 |
| | | | | | 19232–19389 |
| | | | | | 19808–19878 |
| | | | | | 20060–20245 |
| | | | | | 20461–20870 |
| | | | | | 20975–21108 |
| | | | | | 21181–21600 |
| | | | | | 21611–22253 |
| HDPXY88 | 1370 | 1124960 | AC006064 | 11810 | 1–86 |
| HDQFU27 | 1374 | 893681 | AC008622 | 11811 | 1–2910 |
| HDQFU27 | 1374 | 893681 | AC025983 | 11812 | 1–2473 |
| HDQFU27 | 1374 | 893681 | AC008622 | 11813 | 1–199 |
| HDQFU73 | 1375 | 1090935 | AC060796 | 11814 | 1–1109 |
| HDQGO29 | 1376 | 926675 | AC061972 | 11815 | 1–2658 |
| HDQGO29 | 1376 | 926675 | AC061974 | 11816 | 1–2658 |
| HDQGO29 | 1376 | 926675 | AC061972 | 11817 | 1–605 |
| | | | | | 1918–2562 |
| HDQGO29 | 1376 | 926675 | AC061974 | 11818 | 1–605 |
| HDQHC29 | 1378 | 893835 | AC020635 | 11819 | 1–472 |
| | | | | | 574–858 |
| | | | | | 1009–1118 |
| | | | | | 2488–2994 |
| | | | | | 3103–3191 |
| | | | | | 3623–3724 |
| | | | | | 3996–4803 |
| | | | | | 4881–5016 |
| | | | | | 5098–5221 |
| | | | | | 5440–5764 |
| | | | | | 5921–6005 |
| | | | | | 6123–6215 |
| | | | | | 6428–6604 |
| | | | | | 6729–6867 |
| | | | | | 7236–7399 |
| | | | | | 7633–7736 |
| | | | | | 7885–8051 |
| | | | | | 8134–8287 |
| | | | | | 8484–8645 |
| | | | | | 8801–8886 |
| | | | | | 9057–9575 |
| | | | | | 10165–10350 |
| | | | | | 10447–10609 |
| | | | | | 10860–11000 |
| | | | | | 11084–11461 |
| | | | | | 11539–11692 |
| | | | | | 11812–11974 |
| | | | | | 12126–12259 |
| | | | | | 12344–12481 |
| | | | | | 12987–13152 |
| | | | | | 13247–14268 |
| | | | | | 14349–14491 |
| | | | | | 14658–14791 |
| | | | | | 14907–15018 |
| | | | | | 15097–15238 |
| | | | | | 15334–15433 |
| | | | | | 15501–17838 |
| | | | | | 17978–18066 |
| | | | | | 18156–18340 |
| | | | | | 18387–18871 |
| HDQHC29 | 1378 | 893835 | AC020635 | 11820 | 1–574 |
| HDQHQ91 | 1380 | 975829 | AC011498 | 11821 | 1–53 |
| | | | | | 1084–3625 |
| HDQHQ91 | 1380 | 975829 | AC011498 | 11822 | 1–88 |
| HDQHY04 | 1381 | 903650 | AL358194 | 11823 | 1–3510 |
| HDQHY04 | 1381 | 903650 | AL157713 | 11824 | 1–3549 |
| HDQHY04 | 1381 | 903650 | AL358194 | 11825 | 1–325 |
| HDQHY04 | 1381 | 903650 | AL157713 | 11826 | 1–325 |
| HDQIH54 | 1382 | 911927 | AL109823 | 11827 | 1–140 |
| | | | | | 4350–4770 |
| | | | | | 5288–7968 |
| | | | | | 8470–8668 |
| | | | | | 9992–10389 |
| | | | | | 12748–13812 |
| | | | | | 16369–16522 |
| | | | | | 17830–18014 |
| | | | | | 18648–18744 |
| | | | | | 19068–19466 |
| | | | | | 19817–19961 |
| | | | | | 20861–21321 |
| | | | | | 22142–22410 |
| | | | | | 22688–22771 |
| | | | | | 24710–26032 |
| | | | | | 28340–28950 |
| | | | | | 29355–29905 |
| | | | | | 31089–31391 |
| | | | | | 31953–32426 |
| | | | | | 32435–33601 |
| | | | | | 33827–33980 |
| | | | | | 35352–36135 |
| HDQIH54 | 1382 | 911927 | AL109823 | 11828 | 1–256 |
| HDQIH54 | 1382 | 911927 | AL109823 | 11829 | 1–485 |
| HDTAR06 | 1393 | 1002989 | AB023049 | 11830 | 1–361 |
| | | | | | 1717–1958 |
| | | | | | 2040–2204 |
| | | | | | 2528–2582 |
| | | | | | 4776–4959 |
| | | | | | 7250–7505 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 7708–7914 |
| | | | | | 7990–8184 |
| | | | | | 8945–9160 |
| | | | | | 9961–10075 |
| | | | | | 10236–10354 |
| | | | | | 10508–11228 |
| | | | | | 11656–11790 |
| | | | | | 11900–12003 |
| | | | | | 12104–12232 |
| | | | | | 12312–12623 |
| | | | | | 12739–12953 |
| | | | | | 13147–13249 |
| | | | | | 13357–13515 |
| | | | | | 15209–15643 |
| | | | | | 15870–16032 |
| | | | | | 16221–16388 |
| | | | | | 16471–17066 |
| | | | | | 17384–17548 |
| | | | | | 17641–17820 |
| | | | | | 18102–18280 |
| | | | | | 19642–20490 |
| | | | | | 20520–20731 |
| | | | | | 21541–21850 |
| | | | | | 21913–22016 |
| | | | | | 22224–22404 |
| | | | | | 22599–23453 |
| | | | | | 23676–24068 |
| | | | | | 24170–24271 |
| | | | | | 25162–25349 |
| | | | | | 25351–25580 |
| | | | | | 25706–25857 |
| HDTAR06 | 1393 | 1002989 | AB023049 | 11831 | 1–134 |
| HDTAR06 | 1393 | 1002989 | AB023049 | 11832 | 1–1041 |
| | | | | | 1114–1189 |
| | | | | | 1744–1863 |
| | | | | | 2405–4177 |
| | | | | | 4425–5366 |
| | | | | | 5374–5931 |
| | | | | | 6265–6640 |
| | | | | | 6667–6715 |
| | | | | | 7311–7626 |
| | | | | | 8094–8588 |
| | | | | | 9124–9241 |
| | | | | | 10225–10261 |
| | | | | | 10518–10771 |
| | | | | | 10863–11080 |
| | | | | | 11802–12364 |
| | | | | | 13285–13401 |
| | | | | | 13674–13921 |
| | | | | | 14815–15446 |
| | | | | | 15597–15746 |
| | | | | | 16293–16568 |
| | | | | | 17293–17534 |
| | | | | | 18451–18764 |
| | | | | | 18946–19060 |
| | | | | | 19170–19239 |
| | | | | | 19363–19457 |
| | | | | | 19573–19631 |
| | | | | | 20099–20247 |
| HE2AX96 | 1415 | 961220 | AC006512 | 11833 | 1–658 |
| | | | | | 3090–3543 |
| | | | | | 4479–5105 |
| | | | | | 5885–6846 |
| | | | | | 7103–9707 |
| | | | | | 9914–10293 |
| | | | | | 11523–12034 |
| | | | | | 12067–12181 |
| | | | | | 13769–14031 |
| | | | | | 14199–14291 |
| | | | | | 14584–14790 |
| | | | | | 15123–15154 |
| | | | | | 17039–17482 |
| | | | | | 17539–17987 |
| | | | | | 18697–19052 |
| | | | | | 19112–19380 |
| | | | | | 20023–20268 |
| | | | | | 21158–21598 |
| | | | | | 21817–22221 |
| | | | | | 23565–23665 |
| | | | | | 23906–24076 |
| | | | | | 24981–25506 |
| | | | | | 25510–25861 |
| | | | | | 25981–26645 |
| | | | | | 26661–27449 |
| | | | | | 27717–27812 |
| | | | | | 27991–28024 |
| | | | | | 28437–28888 |
| | | | | | 29651–33442 |
| | | | | | 33621–34089 |
| | | | | | 34245–34808 |
| | | | | | 34819–35284 |
| | | | | | 35854–35960 |
| | | | | | 38525–38771 |
| HE2AX96 | 1415 | 961220 | AC021921 | 11834 | 1–170 |
| HE2AX96 | 1415 | 961220 | AL365209 | 11835 | 1–109 |
| HE2AX96 | 1415 | 961220 | AC019092 | 11836 | 1–184 |
| HE2AX96 | 1415 | 961220 | AC027264 | 11837 | 1–147 |
| HE2AX96 | 1415 | 961220 | AC024337 | 11838 | 1–235 |
| HE2AX96 | 1415 | 961220 | AC055805 | 11839 | 1–143 |
| HE2AX96 | 1415 | 961220 | AC055788 | 11840 | 1–170 |
| HE2AX96 | 1415 | 961220 | AC026980 | 11841 | 1–171 |
| HE2AX96 | 1415 | 961220 | AC023672 | 11842 | 1–196 |
| HE2AX96 | 1415 | 961220 | AC023583 | 11843 | 1–183 |
| HE2AX96 | 1415 | 961220 | AC009899 | 11844 | 1–175 |
| HE2AX96 | 1415 | 961220 | AC025181 | 11845 | 1–159 |
| HE2AX96 | 1415 | 961220 | AC012461 | 11846 | 1–207 |
| HE2AX96 | 1415 | 961220 | AC027772 | 11847 | 1–189 |
| HE2AX96 | 1415 | 961220 | AC027408 | 11848 | 1–207 |
| HE2AX96 | 1415 | 961220 | AC027584 | 11849 | 1–162 |
| HE2AX96 | 1415 | 961220 | AC022091 | 11850 | 1–267 |
| HE2AX96 | 1415 | 961220 | AC016630 | 11851 | 1–246 |
| HE2AX96 | 1415 | 961220 | AC011101 | 11852 | 1–100 |
| HE2AX96 | 1415 | 961220 | AC023309 | 11853 | 1–193 |
| HE2AX96 | 1415 | 961220 | AC024361 | 11854 | 1–177 |
| HE2AX96 | 1415 | 961220 | AC073446 | 11855 | 1–140 |
| HE2AX96 | 1415 | 961220 | AC024475 | 11856 | 1–187 |
| HE2AX96 | 1415 | 961220 | AC016699 | 11857 | 1–1714 |
| HE2AX96 | 1415 | 961220 | AC067779 | 11858 | 1–246 |
| HE2AX96 | 1415 | 961220 | AC026556 | 11859 | 1–114 |
| HE2AX96 | 1415 | 961220 | AL353694 | 11860 | 1–173 |
| HE2AX96 | 1415 | 961220 | AL161613 | 11861 | 1–63 |
| HE2AX96 | 1415 | 961220 | AC068682 | 11862 | 1–153 |
| HE2AX96 | 1415 | 961220 | AC034137 | 11863 | 1–202 |
| HE2AX96 | 1415 | 961220 | AL356423 | 11864 | 1–203 |
| HE2AX96 | 1415 | 961220 | AC068755 | 11865 | 1–190 |
| HE2AX96 | 1415 | 961220 | AC023315 | 11866 | 1–108 |
| HE2AX96 | 1415 | 961220 | AC016319 | 11867 | 1–191 |
| HE2AX96 | 1415 | 961220 | AC011036 | 11868 | 1–193 |
| HE2AX96 | 1415 | 961220 | AC010853 | 11869 | 1–195 |
| HE2AX96 | 1415 | 961220 | AP000590 | 11870 | 1–182 |
| HE2AX96 | 1415 | 961220 | AC010984 | 11871 | 1–141 |
| HE2AX96 | 1415 | 961220 | AC048382 | 11872 | 1–115 |
| HE2AX96 | 1415 | 961220 | AC026144 | 11873 | 1–183 |
| HE2AX96 | 1415 | 961220 | AL353659 | 11874 | 1–202 |
| HE2AX96 | 1415 | 961220 | AC068289 | 11875 | 1–192 |
| HE2AX96 | 1415 | 961220 | AC023583 | 11876 | 1–153 |
| HE2AX96 | 1415 | 961220 | AC016142 | 11877 | 1–150 |
| HE2AX96 | 1415 | 961220 | AC010882 | 11878 | 1–135 |
| HE2AX96 | 1415 | 961220 | AC023864 | 11879 | 1–142 |
| HE2AX96 | 1415 | 961220 | AL354696 | 11880 | 1–181 |
| HE2AX96 | 1415 | 961220 | AF287957 | 11881 | 1–122 |
| HE2AX96 | 1415 | 961220 | AC073219 | 11882 | 1–123 |
| HE2AX96 | 1415 | 961220 | AL139131 | 11883 | 1–214 |
| HE2AX96 | 1415 | 961220 | AC040985 | 11884 | 1–177 |
| HE2AX96 | 1415 | 961220 | AL356318 | 11885 | 1–187 |
| HE2AX96 | 1415 | 961220 | AC022276 | 11886 | 1–166 |
| HE2AX96 | 1415 | 961220 | AC000360 | 11887 | 1–142 |
| HE2AX96 | 1415 | 961220 | AC006512 | 11888 | 1–315 |
| | | | | | 439–531 |
| | | | | | 707–1080 |
| | | | | | 1144–1227 |
| | | | | | 1491–1845 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 2113–2321 |
| | | | | | 2700–3556 |
| | | | | | 3818–4307 |
| | | | | | 4336–4813 |
| | | | | | 4958–5775 |
| HE2AX96 | 1415 | 961220 | AC006512 | 11889 | 1–738 |
| HE2AX96 | 1415 | 961220 | AC019092 | 11890 | 1–268 |
| HE2AX96 | 1415 | 961220 | AC027584 | 11891 | 1–368 |
| HE2AX96 | 1415 | 961220 | AC016630 | 11892 | 1–131 |
| HE2AX96 | 1415 | 961220 | AC073446 | 11893 | 1–52 |
| | | | | | 2626–2925 |
| HE2AX96 | 1415 | 961220 | AC016699 | 11894 | 1–534 |
| HE2AX96 | 1415 | 961220 | AC067779 | 11895 | 1–1558 |
| | | | | | 1589–4706 |
| HE2AX96 | 1415 | 961220 | AL161613 | 11896 | 1–129 |
| HE2AX96 | 1415 | 961220 | AC023583 | 11897 | 1–59 |
| | | | | | 1391–1548 |
| HE2AX96 | 1415 | 961220 | AC023864 | 11898 | 1–1485 |
| | | | | | 1590–4704 |
| HE2AX96 | 1415 | 961220 | AF287957 | 11899 | 1–1090 |
| HE2GS36 | 1429 | 779386 | AL022169 | 11900 | 1–952 |
| | | | | | 1287–1407 |
| | | | | | 1970–2125 |
| HE2LW65 | 1433 | 1222608 | AC004837 | 11901 | 1–139 |
| | | | | | 909–1208 |
| | | | | | 4162–4709 |
| | | | | | 4838–7963 |
| HE2LW65 | 1433 | 1222608 | AC004837 | 11902 | 1–435 |
| HE2OW03 | 1437 | 1127892 | AL031782 | 11903 | 1–965 |
| HE2OW03 | 1437 | 1127892 | AL139091 | 11904 | 1–965 |
| HE2RO22 | 1441 | 1139886 | AC068198 | 11905 | 1–720 |
| | | | | | 836–1282 |
| | | | | | 1316–2272 |
| HE2RO22 | 1441 | 1139886 | AL162271 | 11906 | 1–720 |
| | | | | | 836–1282 |
| | | | | | 1316–2272 |
| HE2RO22 | 1441 | 1139886 | AC068198 | 11907 | 1–1107 |
| | | | | | 1155–1429 |
| | | | | | 1733–2881 |
| HE2RO22 | 1441 | 1139886 | AL162271 | 11908 | 1–1114 |
| | | | | | 1162–1436 |
| | | | | | 1740–2888 |
| HE6CL49 | 1444 | 531981 | AL163193 | 11909 | 1–828 |
| HE6CL49 | 1444 | 531981 | AL163193 | 11910 | 1–393 |
| HE8AO36 | 1456 | 1041009 | AC005940 | 11911 | 1–793 |
| HE8AO36 | 1456 | 1041009 | AC011189 | 11912 | 1–79 |
| | | | | | 157–551 |
| | | | | | 885–1425 |
| | | | | | 1807–1995 |
| | | | | | 2250–3065 |
| | | | | | 3353–3448 |
| | | | | | 3666–3769 |
| HE8AO36 | 1456 | 1041009 | AC002993 | 11913 | 1–83 |
| | | | | | 161–555 |
| | | | | | 893–1437 |
| | | | | | 1759–2170 |
| | | | | | 2263–3078 |
| | | | | | 3368–3512 |
| | | | | | 3679–3784 |
| | | | | | 5484–5651 |
| | | | | | 6489–6800 |
| | | | | | 7418–7611 |
| | | | | | 8793–8945 |
| | | | | | 9721–10337 |
| | | | | | 10584–10752 |
| | | | | | 11796–13554 |
| HE8AO36 | 1456 | 1041009 | AC005940 | 11914 | 1–541 |
| | | | | | 923–1111 |
| HE8AO36 | 1456 | 1041009 | AC011189 | 11915 | 1–246 |
| HE8AO36 | 1456 | 1041009 | AC002993 | 11916 | 1–235 |
| HE8AO36 | 1456 | 1041009 | AC002993 | 11917 | 1–556 |
| HE8EW79 | 1468 | 1352215 | AC026737 | 11918 | 1–3515 |
| | | | | | 5475–5869 |
| | | | | | 6310–6577 |
| | | | | | 7002–7399 |
| HE8EW79 | 1468 | 1352215 | AC026737 | 11919 | 1–521 |
| HE8MH77 | 1475 | 984097 | AC024515 | 11920 | 1–476 |
| | | | | | 1090–1438 |
| | | | | | 1462–3453 |
| HE8MH77 | 1475 | 984097 | AC024515 | 11921 | 1–519 |
| HE8NQ42 | 1478 | 1125219 | AL121716 | 11922 | 1–45 |
| | | | | | 155–335 |
| | | | | | 1852–2459 |
| | | | | | 5452–5592 |
| | | | | | 7052–8337 |
| | | | | | 8694–8798 |
| | | | | | 8925–9369 |
| | | | | | 9732–9978 |
| | | | | | 10663–11089 |
| | | | | | 11528–11594 |
| | | | | | 11818–11959 |
| | | | | | 12220–12299 |
| | | | | | 13338–14475 |
| | | | | | 14910–15216 |
| | | | | | 15885–16037 |
| | | | | | 17114–17254 |
| | | | | | 17937–18218 |
| | | | | | 18501–18555 |
| | | | | | 19729–19897 |
| | | | | | 22126–22856 |
| | | | | | 24807–29866 |
| | | | | | 30223–31284 |
| | | | | | 31863–31996 |
| | | | | | 32164–32323 |
| | | | | | 33680–33964 |
| | | | | | 34311–34426 |
| | | | | | 35895–35996 |
| | | | | | 38604–38692 |
| | | | | | 39744–39902 |
| | | | | | 41671–41867 |
| HE8NQ42 | 1478 | 1125219 | AL139333 | 11923 | 1–45 |
| | | | | | 155–335 |
| | | | | | 1852–2459 |
| HE8NQ42 | 1478 | 1125219 | AL121716 | 11924 | 1–507 |
| HE8NQ42 | 1478 | 1125219 | AL121716 | 11925 | 1–456 |
| HE8NQ42 | 1478 | 1125219 | AL139333 | 11926 | 1–456 |
| HE8OK73 | 1479 | 1043304 | AP001944 | 11927 | 1–1804 |
| HE8OK73 | 1479 | 1043304 | AC018575 | 11928 | 1–1804 |
| HE8OK73 | 1479 | 1043304 | AC022317 | 11929 | 1–1804 |
| HE8PW38 | 1480 | 1025098 | AC012598 | 11930 | 1–1931 |
| HE8PW38 | 1480 | 1025098 | AC012565 | 11931 | 1–1752 |
| HE8QG24 | 1482 | 1043448 | AC078898 | 11932 | 1–640 |
| HE8QG24 | 1482 | 1043448 | AC074196 | 11933 | 1–606 |
| HE8QG24 | 1482 | 1043448 | AC077693 | 11934 | 1–628 |
| HE8QG24 | 1482 | 1043448 | AC027037 | 11935 | 1–640 |
| HE8QG24 | 1482 | 1043448 | AC026757 | 11936 | 1–513 |
| HE8QG24 | 1482 | 1043448 | AC027036 | 11937 | 1–612 |
| HE8QG24 | 1482 | 1043448 | AC074108 | 11938 | 1–462 |
| HE8QG24 | 1482 | 1043448 | AC074226 | 11939 | 1–640 |
| HE8QG24 | 1482 | 1043448 | AC073166 | 11940 | 1–640 |
| HE8QG24 | 1482 | 1043448 | AC068667 | 11941 | 1–654 |
| HE8QG24 | 1482 | 1043448 | AC024594 | 11942 | 1–414 |
| HE8QG24 | 1482 | 1043448 | AC024261 | 11943 | 1–647 |
| HE8QG24 | 1482 | 1043448 | AC078893 | 11944 | 1–640 |
| HE8QG24 | 1482 | 1043448 | AC073555 | 11945 | 1–640 |
| HE8QG24 | 1482 | 1043448 | AC069474 | 11946 | 1–571 |
| HE8QG24 | 1482 | 1043448 | AC068924 | 11947 | 1–640 |
| HE8QG24 | 1482 | 1043448 | AC066689 | 11948 | 1–639 |
| HE8QG24 | 1482 | 1043448 | AC034258 | 11949 | 1–648 |
| HE8QG24 | 1482 | 1043448 | AC027135 | 11950 | 1–434 |
| HE8QG24 | 1482 | 1043448 | AC027035 | 11951 | 1–624 |
| HE8QG24 | 1482 | 1043448 | AC027034 | 11952 | 1–509 |
| HE8QG24 | 1482 | 1043448 | AC026815 | 11953 | 1–654 |
| HE8QG24 | 1482 | 1043448 | AC025781 | 11954 | 1–546 |
| HE8QG24 | 1482 | 1043448 | AC022735 | 11955 | 1–2602 |
| HE8QG24 | 1482 | 1043448 | AC078894 | 11956 | 1–654 |
| HE8QG24 | 1482 | 1043448 | AC022735 | 11957 | 1–523 |
| HE8QT72 | 1484 | 961193 | AC018900 | 11958 | 1–65 |
| | | | | | 175–275 |
| | | | | | 505–590 |
| | | | | | 1039–1164 |
| | | | | | 1861–1949 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 2695–2914 |
| | | | | | 3021–3150 |
| | | | | | 3483–3638 |
| | | | | | 3728–4338 |
| HE8QT72 | 1484 | 961193 | AC018900 | 11959 | 1–70 |
| | | | | | 504–564 |
| | | | | | 2078–2335 |
| | | | | | 2559–3145 |
| | | | | | 4386–4975 |
| | | | | | 5038–5201 |
| | | | | | 5354–6773 |
| HE8QV43 | 1485 | 1034601 | AL157392 | 11960 | 1–1597 |
| HE8QV43 | 1485 | 1034601 | AL157392 | 11961 | 1–2017 |
| HE8UT25 | 1489 | 1036044 | AC016135 | 11962 | 1–845 |
| HE8UY36 | 1490 | 961223 | AC009511 | 11963 | 1–2312 |
| HE8UY36 | 1490 | 961223 | AC009511 | 11964 | 1–192 |
| HE8UY36 | 1490 | 961223 | AC009511 | 11965 | 1–78 |
| | | | | | 189–2188 |
| | | | | | 2507–3214 |
| | | | | | 3366–3818 |
| | | | | | 3842–5304 |
| | | | | | 5337–6484 |
| | | | | | 6609–6798 |
| | | | | | 6820–8891 |
| HE9PM90 | 1507 | 899507 | AC004985 | 11966 | 1–223 |
| | | | | | 382–577 |
| | | | | | 1797–2016 |
| | | | | | 2501–2977 |
| HE9PM90 | 1507 | 899507 | AC004985 | 11967 | 1–448 |
| HE9PM90 | 1507 | 899507 | AC004985 | 11968 | 1–727 |
| HE9RO27 | 1511 | 1002358 | AL158839 | 11969 | 1–1912 |
| HE9RO27 | 1511 | 1002358 | AL158839 | 11970 | 1–307 |
| HE9RO27 | 1511 | 1002358 | AL158839 | 11971 | 1–283 |
| HE9SE18 | 1513 | 1043305 | AC069212 | 11972 | 1–2532 |
| HE9SE18 | 1513 | 1043305 | AC012553 | 11973 | 1–2532 |
| HE9SE18 | 1513 | 1043305 | AC069212 | 11974 | 1–126 |
| HE9SE18 | 1513 | 1043305 | AC012553 | 11975 | 1–126 |
| HEBAH57 | 1518 | 1013754 | AC016893 | 11976 | 1–3022 |
| HEBDF05 | 1522 | 973964 | AC016893 | 11977 | 1–3022 |
| HEEAG84 | 1528 | 1035200 | AC069439 | 11978 | 1–2337 |
| HEEAG84 | 1528 | 1035200 | AC069439 | 11979 | 1–1505 |
| HEEAM62 | 1530 | 910116 | AC005722 | 11980 | 1–114 |
| | | | | | 1330–1431 |
| | | | | | 1758–1825 |
| | | | | | 2571–2724 |
| | | | | | 3148–3359 |
| | | | | | 3804–3843 |
| | | | | | 4161–4288 |
| | | | | | 4928–5040 |
| | | | | | 7786–8246 |
| | | | | | 8705–8798 |
| | | | | | 9517–10154 |
| | | | | | 11043–11724 |
| HEEAM62 | 1530 | 910116 | AC005722 | 11981 | 1–506 |
| HEGAK23 | 1535 | 1219817 | AC072032 | 11982 | 1–364 |
| HEGAK23 | 1535 | 1219817 | AC002518 | 11983 | 1–247 |
| HEGAK23 | 1535 | 1219817 | AC018512 | 11984 | 1–776 |
| HEGAK23 | 1535 | 1219817 | AC022305 | 11985 | 1–686 |
| HEGAK23 | 1535 | 1219817 | AC022305 | 11986 | 1–878 |
| HEGAK23 | 1535 | 1219817 | AC016135 | 11987 | 1–845 |
| HEGAK23 | 1535 | 1219817 | AC078916 | 11988 | 1–364 |
| HEGAK23 | 1535 | 1219817 | AC072032 | 11989 | 1–288 |
| HEGAK23 | 1535 | 1219817 | AC078916 | 11990 | 1–288 |
| HELDL29 | 1548 | 421942 | AP000935 | 11991 | 1–1308 |
| HEMDX17 | 1561 | 704096 | AC009028 | 11992 | 1–299 |
| | | | | | 3280–3958 |
| HEMFS60 | 1564 | 837877 | AC015525 | 11993 | 1–214 |
| | | | | | 2071–2228 |
| | | | | | 3734–3903 |
| | | | | | 4134–4439 |
| | | | | | 6845–6942 |
| | | | | | 7079–9456 |
| HEMFS60 | 1564 | 837877 | AC069420 | 11994 | 1–214 |
| | | | | | 2071–2228 |
| | | | | | 3734–3903 |
| | | | | | 4134–4439 |
| | | | | | 6844–6941 |
| | | | | | 7078–9455 |
| HEMFS60 | 1564 | 837877 | AC015525 | 11995 | 1–552 |
| | | | | | 882–1581 |
| | | | | | 2740–3240 |
| | | | | | 3452–5364 |
| | | | | | 5693–5789 |
| | | | | | 5796–6743 |
| | | | | | 8567–9181 |
| HEOMX53 | 1571 | 904471 | AC027349 | 11996 | 1–120 |
| | | | | | 1257–1358 |
| | | | | | 1840–2044 |
| | | | | | 4400–4682 |
| | | | | | 5025–10099 |
| HEOMXS3 | 1571 | 904471 | AC027349 | 11997 | 1–152 |
| HERAH36 | 1590 | 230462 | Z82196 | 11998 | 1–1084 |
| | | | | | 1138–1463 |
| | | | | | 1541–5253 |
| | | | | | 5425–6012 |
| HERAH36 | 1590 | 230462 | AP002531 | 11999 | 1–367 |
| | | | | | 399–4057 |
| | | | | | 4222–4499 |
| HERAH36 | 1590 | 230462 | AL359234 | 12000 | 1–288 |
| HERAH36 | 1590 | 230462 | AL138743 | 12001 | 1–1757 |
| | | | | | 2477–2642 |
| | | | | | 2651–2726 |
| | | | | | 3349–3493 |
| | | | | | 3625–3818 |
| | | | | | 4834–4961 |
| | | | | | 5049–5611 |
| | | | | | 7190–7309 |
| | | | | | 11676–12103 |
| | | | | | 12118–12589 |
| | | | | | 13652–14060 |
| | | | | | 14723–15121 |
| | | | | | 15565–15856 |
| | | | | | 16191–18115 |
| | | | | | 18216–19065 |
| | | | | | 20338–20446 |
| | | | | | 20635–20723 |
| | | | | | 20862–21117 |
| | | | | | 24785–25078 |
| | | | | | 27865–28115 |
| | | | | | 30509–30747 |
| | | | | | 33654–36925 |
| HERAH36 | 1590 | 230462 | AL137022 | 12002 | 1–4109 |
| HERAH36 | 1590 | 230462 | AL136297 | 12003 | 1–4810 |
| HERAH36 | 1590 | 230462 | AL136088 | 12004 | 1–360 |
| | | | | | 465–2015 |
| | | | | | 2213–3889 |
| HERAH36 | 1590 | 230462 | AL121964 | 12005 | 1–4908 |
| HERAH36 | 1590 | 230462 | AL121868 | 12006 | 1–3368 |
| | | | | | 26808–27027 |
| | | | | | 42677–42894 |
| | | | | | 43942–45964 |
| HERAH36 | 1590 | 230462 | AL109758 | 12007 | 1–6065 |
| | | | | | 6397–6970 |
| | | | | | 7558–7582 |
| HERAH36 | 1590 | 230462 | AL109733 | 12008 | 1–359 |
| | | | | | 465–3700 |
| HERAH36 | 1590 | 230462 | AL096800 | 12009 | 1–332 |
| | | | | | 455–3689 |
| HERAH36 | 1590 | 230462 | AL049821 | 12010 | 1–5666 |
| HERAH36 | 1590 | 230462 | AL049778 | 12011 | 1–3694 |
| HERAH36 | 1590 | 230462 | AL035427 | 12012 | 1–910 |
| | | | | | 943–1095 |
| | | | | | 5347–5640 |
| | | | | | 5768–5879 |
| | | | | | 7138–7314 |
| | | | | | 7715–8057 |
| | | | | | 12531–12643 |
| | | | | | 15040–20767 |
| HERAH36 | 1590 | 230462 | AL034410 | 12013 | 1–2910 |
| HERAH36 | 1590 | 230462 | AL034399 | 12014 | 1–5104 |
| HERAH36 | 1590 | 230462 | AL022723 | 12015 | 1–724 |
| | | | | | 1030–5518 |

TABLE 1C-continued

| cDNA Clone ID | SEQ ID NO: X | CONTIG ID: | BAC ID: A | SEQ ID NO: B | EXON From-To |
|---|---|---|---|---|---|
| HERAH36 | 1590 | 230462 | AF248484 | 12016 | 1–6077 |
|  |  |  |  |  | 6798–8160 |
|  |  |  |  |  | 8165–11740 |
| HERAH36 | 1590 | 230462 | AF127577 | 12017 | 1–6078 |
|  |  |  |  |  | 6799–8155 |
|  |  |  |  |  | 8166–11741 |
| HERAH36 | 1590 | 230462 | AF109076 | 12018 | 1–4432 |
|  |  |  |  |  | 4474–4614 |
|  |  |  |  |  | 4794–4890 |
|  |  |  |  |  | 5088–5886 |
|  |  |  |  |  | 5891–7969 |
| HERAH36 | 1590 | 230462 | AF104455 | 12019 | 1–635 |
|  |  |  |  |  | 741–4504 |
| HERAH36 | 1590 | 230462 | AF064862 | 12020 | 1–5134 |
|  |  |  |  |  | 5169–6044 |
|  |  |  |  |  | 7201–7532 |
|  |  |  |  |  | 10502–10869 |
|  |  |  |  |  | 10883–16344 |
| HERAH36 | 1590 | 230462 | AC040172 | 12021 | 1–1761 |
|  |  |  |  |  | 1829–2662 |
| HERAH36 | 1590 | 230462 | AC040163 | 12022 | 1–359 |
|  |  |  |  |  | 870–1517 |
|  |  |  |  |  | 44256–46016 |
|  |  |  |  |  | 46084–46917 |
| HERAH36 | 1590 | 230462 | AC010632 | 12023 | 1–4503 |
| HERAH36 | 1590 | 230462 | AC009301 | 12024 | 1–1377 |
|  |  |  |  |  | 1575–3148 |
| HERAH36 | 1590 | 230462 | AC008518 | 12025 | 1–5256 |
| HERAH36 | 1590 | 230462 | AC008178 | 12026 | 1–411 |
|  |  |  |  |  | 882–3499 |
| HERAH36 | 1590 | 230462 | AC008071 | 12027 | 1–675 |
| HERAH36 | 1590 | 230462 | AC008065 | 12028 | 1–4940 |
| HERAH36 | 1590 | 230462 | AC007919 | 12029 | 1–4885 |
| HERAH36 | 1590 | 230462 | AC007064 | 12030 | 1–361 |
|  |  |  |  |  | 466–3593 |
| HERAH36 | 1590 | 230462 | AC006962 | 12031 | 1–4783 |
| HERAH36 | 1590 | 230462 | AC006313 | 12032 | 1–57 |
|  |  |  |  |  | 75–4235 |
|  |  |  |  |  | 4243–6631 |
| HERAH36 | 1590 | 230462 | AC006221 | 12033 | 1–359 |
|  |  |  |  |  | 445–3561 |
| HERAH36 | 1590 | 230462 | AC005993 | 12034 | 1–326 |
| HERAH36 | 1590 | 230462 | AC005SO9 | 12035 | 1–374 |
|  |  |  |  |  | 4168–4420 |
|  |  |  |  |  | 38845–39924 |
|  |  |  |  |  | 39978–40410 |
|  |  |  |  |  | 40439–43673 |
|  |  |  |  |  | 43883–44292 |
|  |  |  |  |  | 79643–80117 |
|  |  |  |  |  | 82157–82553 |
| HERAH36 | 1590 | 230462 | AC005386 | 12036 | 1–289 |
| HERAH36 | 1590 | 230462 | AC005187 | 12037 | 1–548 |
|  |  |  |  |  | 580–1378 |
|  |  |  |  |  | 1478–2387 |
| HERAH36 | 1590 | 230462 | AC005166 | 12038 | 1–5485 |
| HERAH36 | 1590 | 230462 | AC005157 | 12039 | 1–711 |
|  |  |  |  |  | 920–1338 |
|  |  |  |  |  | 1420–4730 |
|  |  |  |  |  | 10724–10852 |
|  |  |  |  |  | 14023–18858 |
| HERAH36 | 1590 | 230462 | AC005023 | 12040 | 1–1320 |
|  |  |  |  |  | 1322–5781 |
| HERAH36 | 1590 | 230462 | AC004460 | 12041 | 1–4943 |
| HERAH36 | 1590 | 230462 | AC004253 | 12042 | 1–511 |
|  |  |  |  |  | 7655–12637 |
| HERAH36 | 1590 | 230462 | AC003098 | 12043 | 1–4959 |
|  |  |  |  |  | 4968–5334 |
| HERAH36 | 1590 | 230462 | AC002468 | 12044 | 1–548 |
|  |  |  |  |  | 802–1098 |
|  |  |  |  |  | 1227–1497 |
|  |  |  |  |  | 1718–2318 |
| HERAH36 | 1590 | 230462 | AC002403 | 12045 | 1–4811 |
| HERAH36 | 1590 | 230462 | AC002086 | 12046 | 1–5621 |
| HERAH36 | 1590 | 230462 | AC002041 | 12047 | 1–4351 |
|  |  |  |  |  | 4474–4906 |
| HERAH36 | 1590 | 230462 | AB045358 | 12048 | 1–418 |
| HERAH36 | 1590 | 230462 | AB042235 | 12049 | 1–433 |
|  |  |  |  |  | 465–4123 |
|  |  |  |  |  | 4288–4565 |
| HERAH36 | 1590 | 230462 | AB023058 | 12050 | 1–1350 |
|  |  |  |  |  | 1367–3277 |
| HERAH36 | 1590 | 230462 | AB014082 | 12051 | 1–4744 |
| HERAH36 | 1590 | 230462 | AL354913 | 12052 | 1–2380 |
| HERAH36 | 1590 | 230462 | AC069525 | 12053 | 1–1642 |
| HERAH36 | 1590 | 230462 | AC058819 | 12054 | 1–163 |
|  |  |  |  |  | 180–835 |
|  |  |  |  |  | 980–1197 |
|  |  |  |  |  | 1353–3778 |
| HERAH36 | 1590 | 230462 | AC037443 | 12055 | 1–360 |
|  |  |  |  |  | 465–3693 |
| HERAH36 | 1590 | 230462 | AC021855 | 12056 | 1–359 |
|  |  |  |  |  | 464–3694 |
| HERAH36 | 1590 | 230462 | AC019025 | 12057 | 1–282 |
|  |  |  |  |  | 384–2867 |
|  |  |  |  |  | 3199–3356 |
| HERAH36 | 1590 | 230462 | AC018594 | 12058 | 1–359 |
|  |  |  |  |  | 464–4114 |
|  |  |  |  |  | 4279–4556 |
| HERAH36 | 1590 | 230462 | AC016880 | 12059 | 1–1671 |
| HERAH36 | 1590 | 230462 | AC012371 | 12060 | 1–1631 |
| HERAH36 | 1590 | 230462 | AL359268 | 12061 | 1–998 |
| HERAH36 | 1590 | 230462 | AL162233 | 12062 | 1–433 |
|  |  |  |  |  | 464–611 |
|  |  |  |  |  | 1789–1999 |
|  |  |  |  |  | 2357–3321 |
| HERAH36 | 1590 | 230462 | AL136449 | 12063 | 1–2423 |
| HERAH36 | 1590 | 230462 | AC026102 | 12064 | 1–293 |
|  |  |  |  |  | 398–2942 |
| HERAH36 | 1590 | 230462 | AC022323 | 12065 | 1–433 |
|  |  |  |  |  | 464–611 |
|  |  |  |  |  | 20187–20440 |
|  |  |  |  |  | 21599–22317 |
|  |  |  |  |  | 23437–24330 |
|  |  |  |  |  | 24658–27386 |
| HERAH36 | 1590 | 230462 | AC020667 | 12066 | 1–622 |
|  |  |  |  |  | 727–874 |
|  |  |  |  |  | 925–1042 |
|  |  |  |  |  | 1213–2683 |
|  |  |  |  |  | 2732–3643 |
| HERAH36 | 1590 | 230462 | AL355859 | 12067 | 1–433 |
|  |  |  |  |  | 464–4121 |
| HERAH36 | 1590 | 230462 | AC026924 | 12068 | 1–1607 |
| HERAH36 | 1590 | 230462 | AC026120 | 12069 | 1–406 |
|  |  |  |  |  | 647–1169 |
|  |  |  |  |  | 1172–3515 |
| HERAH36 | 1590 | 230462 | AC024263 | 12070 | 1–1499 |
|  |  |  |  |  | 1604–4833 |
| HERAH36 | 1590 | 230462 | AC023765 | 12071 | 1–292 |
|  |  |  |  |  | 337–1882 |
|  |  |  |  |  | 1913–4269 |
| HERAH36 | 1590 | 230462 | AC021219 | 12072 | 1–1323 |
| HERAH36 | 1590 | 230462 | AC016105 | 12073 | 1–2320 |
| HERAH36 | 1590 | 230462 | AC011145 | 12074 | 1–3692 |
| HERAH36 | 1590 | 230462 | AC010960 | 12075 | 1–2900 |
| HERAH36 | 1590 | 230462 | AP001190 | 12076 | 1–391 |
|  |  |  |  |  | 485–1328 |
| HERAH36 | 1590 | 230462 | AL359648 | 12077 | 1–1176 |
| HERAH36 | 1590 | 230462 | AL357513 | 12078 | 1–891 |
|  |  |  |  |  | 1157–1287 |
|  |  |  |  |  | 1318–1816 |
| HERAH36 | 1590 | 230462 | AL354943 | 12079 | 1–134 |
|  |  |  |  |  | 655–3036 |
| HERAH36 | 1590 | 230462 | AL161614 | 12080 | 1–465 |
|  |  |  |  |  | 713–4125 |
|  |  |  |  |  | 4290–4567 |
|  |  |  |  |  | 4719–4894 |
| HERAH36 | 1590 | 230462 | AL157831 | 12081 | 1–2564 |
| HERAH36 | 1590 | 230462 | AC026596 | 12082 | 1–1628 |
| HERAH36 | 1590 | 230462 | AC021750 | 12083 | 1–359 |
|  |  |  |  |  | 464–4113 |
|  |  |  |  |  | 4278–4555 |

TABLE 1C-continued

| cDNA Clone ID | SEQ ID NO: X | CONTIG ID: | BAC ID: A | SEQ ID NO: B | EXON From-To |
|---|---|---|---|---|---|
| HERAH36 | 1590 | 230462 | AC021252 | 12084 | 1–359 |
| | | | | | 464–4114 |
| | | | | | 4279–4556 |
| HERAH36 | 1590 | 230462 | AC019052 | 12085 | 1–4121 |
| HERAH36 | 1590 | 230462 | AC015471 | 12086 | 1–2900 |
| HERAH36 | 1590 | 230462 | AC013645 | 12087 | 1–299 |
| HERAH36 | 1590 | 230462 | AC013408 | 12088 | 1–433 |
| | | | | | 464–611 |
| | | | | | 713–3697 |
| HERAH36 | 1590 | 230462 | AC013379 | 12089 | 1–5567 |
| HERAH36 | 1590 | 230462 | AC009443 | 12090 | 1–2092 |
| | | | | | 2125–2984 |
| HERAH36 | 1590 | 230462 | AC009147 | 12091 | 1–1570 |
| | | | | | 1638–2471 |
| HERAH36 | 1590 | 230462 | AC011925 | 12092 | 1–670 |
| HERAH36 | 1590 | 230462 | AP001775 | 12093 | 1–406 |
| | | | | | 408–2216 |
| HERAH36 | 1590 | 230462 | AP001124 | 12094 | 1–5015 |
| HERAH36 | 1590 | 230462 | AC024050 | 12095 | 1–1307 |
| | | | | | 1647–3550 |
| | | | | | 3578–5017 |
| HERAH36 | 1590 | 230462 | AC022099 | 12096 | 1–3659 |
| | | | | | 3823–4100 |
| | | | | | 4254–4429 |
| HERAH36 | 1590 | 230462 | AC011441 | 12097 | 1–1755 |
| | | | | | 2085–2526 |
| HERAH36 | 1590 | 230462 | AC069157 | 12098 | 1–666 |
| HERAH36 | 1590 | 230462 | AP001992 | 12099 | 1–2610 |
| | | | | | 2655–2940 |
| HERAH36 | 1590 | 230462 | AL365355 | 12100 | 1–433 |
| | | | | | 464–4532 |
| HERAH36 | 1590 | 230462 | AL359999 | 12101 | 1–3290 |
| HERAH36 | 1590 | 230462 | AL162571 | 12102 | 1–433 |
| | | | | | 464–3588 |
| HERAH36 | 1590 | 230462 | AL162256 | 12103 | 1–433 |
| | | | | | 464–863 |
| | | | | | 875–4317 |
| HERAH36 | 1590 | 230462 | AC073625 | 12104 | 1–3693 |
| HERAH36 | 1590 | 230462 | AC066591 | 12105 | 1–1322 |
| HERAH36 | 1590 | 230462 | AC027287 | 12106 | 1–355 |
| | | | | | 457–4113 |
| HERAH36 | 1590 | 230462 | AC025748 | 12107 | 1–267 |
| | | | | | 318–2036 |
| | | | | | 8551–8732 |
| | | | | | 10136–10283 |
| | | | | | 12370–13030 |
| HERAH36 | 1590 | 230462 | AC015575 | 12108 | 1–1285 |
| HERAH36 | 1590 | 230462 | AC010368 | 12109 | 1–3688 |
| HERAH36 | 1590 | 230462 | AL356322 | 12110 | 1–5728 |
| HERAH36 | 1590 | 230462 | AC009409 | 12111 | 1–401 |
| HERAH36 | 1590 | 230462 | AC026977 | 12112 | 1–2130 |
| HERAH36 | 1590 | 230462 | AC026844 | 12113 | 1–541 |
| HERAH36 | 1590 | 230462 | AC068945 | 12114 | 1–2284 |
| HERAH36 | 1590 | 230462 | AP001770 | 12115 | 1–2525 |
| HERAH36 | 1590 | 230462 | AL356860 | 12116 | 1–359 |
| | | | | | 465–3688 |
| HERAH36 | 1590 | 230462 | AL356804 | 12117 | 1–2082 |
| | | | | | 2121–2396 |
| | | | | | 2415–2909 |
| | | | | | 2911–4751 |
| HERAH36 | 1590 | 230462 | AL353605 | 12118 | 1–1088 |
| | | | | | 1232–1449 |
| | | | | | 1473–1752 |
| | | | | | 2124–4040 |
| HERAH36 | 1590 | 230462 | AL162735 | 12119 | 1–483 |
| | | | | | 486–3211 |
| HERAH36 | 1590 | 230462 | AC063934 | 12120 | 1–4117 |
| | | | | | 4282–4559 |
| HERAH36 | 1590 | 230462 | AC060805 | 12121 | 1–1314 |
| HERAH36 | 1590 | 230462 | AC031979 | 12122 | 1–1178 |
| HERAH36 | 1590 | 230462 | AC021856 | 12123 | 1–1350 |
| HERAH36 | 1590 | 230462 | AC020674 | 12124 | 1–2772 |
| HERAH36 | 1590 | 230462 | AC018647 | 12125 | 1–3261 |
| | | | | | 3263–5026 |
| | | | | | 5647–6639 |
| HERAH36 | 1590 | 230462 | AC007622 | 12126 | 1–4987 |
| HERAH36 | 1590 | 230462 | AC025660 | 12127 | 1–878 |
| | | | | | 932–1290 |
| | | | | | 1376–4492 |
| HERAH36 | 1590 | 230462 | AL136960 | 12128 | 1–2345 |
| HERAH36 | 1590 | 230462 | AC025681 | 12129 | 1–2225 |
| | | | | | 2390–2667 |
| HERAH36 | 1590 | 230462 | AC008875 | 12130 | 1–361 |
| | | | | | 463–3928 |
| HERAH36 | 1590 | 230462 | AC008555 | 12131 | 1–6034 |
| | | | | | 6076–6704 |
| | | | | | 6709–7661 |
| | | | | | 9833–10474 |
| | | | | | 11046–11398 |
| | | | | | 13235–13694 |
| | | | | | 15470–15706 |
| | | | | | 16453–17174 |
| HERAH36 | 1590 | 230462 | AL355877 | 12132 | 1–3216 |
| HERAH36 | 1590 | 230462 | AC027512 | 12133 | 1–3228 |
| HERAH36 | 1590 | 230462 | AC025567 | 12134 | 1–337 |
| | | | | | 426–1125 |
| HERAH36 | 1590 | 230462 | AP001806 | 12135 | 1–5015 |
| HERAH36 | 1590 | 230462 | AP001394 | 12136 | 1–2865 |
| | | | | | 3110–3778 |
| | | | | | 28662–29574 |
| | | | | | 29718–29934 |
| | | | | | 29958–32992 |
| HERAH36 | 1590 | 230462 | AP001368 | 12137 | 1–334 |
| | | | | | 465–3362 |
| HERAH36 | 1590 | 230462 | AL161424 | 12138 | 1–5642 |
| HERAH36 | 1590 | 230462 | AL157937 | 12139 | 1–298 |
| | | | | | 918–1591 |
| HERAH36 | 1590 | 230462 | AL137863 | 12140 | 1–5453 |
| | | | | | 5725–5809 |
| | | | | | 16205–16592 |
| | | | | | 16905–17244 |
| | | | | | 18995–23699 |
| HERAH36 | 1590 | 230462 | AC073141 | 12141 | 1–2900 |
| HERAH36 | 1590 | 230462 | AC016748 | 12142 | 1–4121 |
| | | | | | 4292–4563 |
| | | | | | 4717–4892 |
| HERAH36 | 1590 | 230462 | AC009096 | 12143 | 1–1759 |
| HERAH36 | 1590 | 230462 | AC044868 | 12144 | 1–2030 |
| HERAH36 | 1590 | 230462 | AP002508 | 12145 | 1–334 |
| | | | | | 337–1277 |
| HERAH36 | 1590 | 230462 | AC073266 | 12146 | 1–4314 |
| HERAH36 | 1590 | 230462 | AC064857 | 12147 | 1–2373 |
| HERAH36 | 1590 | 230462 | AC008575 | 12148 | 1–333 |
| | | | | | 15528–15923 |
| | | | | | 23549–24635 |
| | | | | | 24755–25046 |
| | | | | | 25151–28376 |
| HERAH36 | 1590 | 230462 | AC062019 | 12149 | 1–411 |
| | | | | | 882–3499 |
| HERAH36 | 1590 | 230462 | AC040975 | 12150 | 1–3013 |
| HERAH36 | 1590 | 230462 | AC040908 | 12151 | 1–1817 |
| HERAH36 | 1590 | 230462 | AC069546 | 12152 | 1–43 |
| | | | | | 1123–1410 |
| | | | | | 1718–7359 |
| HERAH36 | 1590 | 230462 | AC025315 | 12153 | 1–666 |
| HERAH36 | 1590 | 230462 | AC010244 | 12154 | 1–277 |
| | | | | | 382–4036 |
| | | | | | 4200–4477 |
| | | | | | 4631–4806 |
| HERAH36 | 1590 | 230462 | AL355295 | 12155 | 1–1181 |
| HERAH36 | 1590 | 230462 | AL157876 | 12156 | 1–2503 |
| HERAH36 | 1590 | 230462 | AC037485 | 12157 | 1–2060 |
| HERAH36 | 1590 | 230462 | AC027048 | 12158 | 1–4120 |
| HERAH36 | 1590 | 230462 | AC021242 | 12159 | 1–358 |
| | | | | | 403–3581 |
| HERAH36 | 1590 | 230462 | AC074346 | 12160 | 1–274 |
| | | | | | 279–4067 |
| HERAH36 | 1590 | 230462 | AC025069 | 12161 | 1–3612 |
| HERAH36 | 1590 | 230462 | AC026935 | 12162 | 1–4426 |
| HERAH36 | 1590 | 230462 | AL390799 | 12163 | 1–2092 |
| | | | | | 2125–2984 |
| HERAH36 | 1590 | 230462 | AL358353 | 12164 | 1–5753 |

TABLE 1C-continued

| cDNA Clone ID | SEQ ID NO: X | CONTIG ID: | BAC ID: A | SEQ ID NO: B | EXON From-To |
|---|---|---|---|---|---|
| HERAH36 | 1590 | 230462 | AL356377 | 12165 | 1–1907 |
| HERAH36 | 1590 | 230462 | AL355773 | 12166 | 1–2057 |
| | | | | | 2529–2690 |
| | | | | | 2695–4959 |
| HERAH36 | 1590 | 230462 | AL355589 | 12167 | 1–4060 |
| HERAH36 | 1590 | 230462 | AL161619 | 12168 | 1–4056 |
| HERAH36 | 1590 | 230462 | AL158832 | 12169 | 1–5567 |
| HERAH36 | 1590 | 230462 | AL138479 | 12170 | 1–1863 |
| | | | | | 4257–4558 |
| | | | | | 12665–12764 |
| | | | | | 21059–21201 |
| | | | | | 23420–28257 |
| HERAH36 | 1590 | 230462 | AL133267 | 12171 | 1–367 |
| | | | | | 398–3628 |
| HERAH36 | 1590 | 230462 | AL122019 | 12172 | 1–1907 |
| HERAH36 | 1590 | 230462 | AL121986 | 12173 | 1–191 |
| | | | | | 242–4506 |
| | | | | | 5016–5342 |
| | | | | | 10328–11129 |
| | | | | | 11760–12171 |
| | | | | | 12274–12554 |
| | | | | | 12909–13004 |
| | | | | | 13404–13974 |
| | | | | | 15669–15945 |
| | | | | | 21241–27310 |
| | | | | | 31930–34167 |
| | | | | | 34234–36631 |
| HERAH36 | 1590 | 230462 | AL121788 | 12174 | 1–1060 |
| HERAH36 | 1590 | 230462 | AF145206 | 12175 | 1–4438 |
| | | | | | 4480–4620 |
| | | | | | 4800–4896 |
| | | | | | 5094–5892 |
| | | | | | 5897–7975 |
| HERAH36 | 1590 | 230462 | AC069059 | 12176 | 1–1687 |
| HERAH36 | 1590 | 230462 | AC025447 | 12177 | 1–3692 |
| HERAH36 | 1590 | 230462 | AC024948 | 12178 | 1–1230 |
| | | | | | 1238–1523 |
| | | | | | 1526–3067 |
| | | | | | 3074–3735 |
| HERAH36 | 1590 | 230462 | AC022033 | 12179 | 1–1581 |
| HERAH36 | 1590 | 230462 | AC022002 | 12180 | 1–2843 |
| | | | | | 2849–2879 |
| HERAH36 | 1590 | 230462 | AC021576 | 12181 | 1–1623 |
| | | | | | 1625–4528 |
| | | | | | 4532–4569 |
| HERAH36 | 1590 | 230462 | AC020804 | 12182 | 1–5707 |
| HERAH36 | 1590 | 230462 | AC020752 | 12183 | 1–2843 |
| | | | | | 2849–2879 |
| HERAH36 | 1590 | 230462 | AC020691 | 12184 | 1–4615 |
| HERAH36 | 1590 | 230462 | AC019354 | 12185 | 1–3899 |
| HERAH36 | 1590 | 230462 | AC019173 | 12186 | 1–3380 |
| | | | | | 3771–4676 |
| | | | | | 9170–9277 |
| | | | | | 10233–10926 |
| | | | | | 11409–11593 |
| | | | | | 20411–20512 |
| | | | | | 25411–25558 |
| | | | | | 27265–27999 |
| | | | | | 31957–32439 |
| | | | | | 33257–33556 |
| | | | | | 33562–33769 |
| | | | | | 34862–38545 |
| | | | | | 38566–38844 |
| | | | | | 38880–39476 |
| | | | | | 39825–40336 |
| | | | | | 70549–70949 |
| | | | | | 78414–80184 |
| | | | | | 81265–81306 |
| HERAH36 | 1590 | 230462 | AC018812 | 12187 | 1–2843 |
| | | | | | 2849–2879 |
| HERAH36 | 1590 | 230462 | AC017082 | 12188 | 1–287 |
| | | | | | 607–2018 |
| HERAH36 | 1590 | 230462 | AC013615 | 12189 | 1–4570 |
| | | | | | 4720–5625 |
| | | | | | 7029–7258 |
| | | | | | 7562–8059 |
| | | | | | 20080–20179 |
| | | | | | 37585–39464 |
| | | | | | 39474–43778 |
| HERAH36 | 1590 | 230462 | AC012199 | 12190 | 1–359 |
| | | | | | 404–3685 |
| HERAH36 | 1590 | 230462 | AC008476 | 12191 | 1–333 |
| | | | | | 15528–15923 |
| | | | | | 23549–24635 |
| | | | | | 24755–25046 |
| | | | | | 25151–28376 |
| HERAH36 | 1590 | 230462 | AC002419 | 12192 | 1–5591 |
| HERAH36 | 1590 | 230462 | AC013405 | 12193 | 1–367 |
| | | | | | 1485–2281 |
| | | | | | 2619–3008 |
| | | | | | 3053–3337 |
| HERAH36 | 1590 | 230462 | AL390117 | 12194 | 1–2560 |
| HERAH36 | 1590 | 230462 | AC068738 | 12195 | 1–1384 |
| | | | | | 1496–2979 |
| | | | | | 8047–8939 |
| | | | | | 9078–9295 |
| | | | | | 9700–12074 |
| HERAH36 | 1590 | 230462 | AC036227 | 12196 | 1–3290 |
| HERAH36 | 1590 | 230462 | AL162740 | 12197 | 1–648 |
| | | | | | 1025–2869 |
| HERAH36 | 1590 | 230462 | AL139288 | 12198 | 1–358 |
| | | | | | 462–3784 |
| | | | | | 4052–4494 |
| HERAH36 | 1590 | 230462 | AC027462 | 12199 | 1–4115 |
| | | | | | 4314–4547 |
| | | | | | 4712–4886 |
| HERAH36 | 1590 | 230462 | AC026022 | 12200 | 1–670 |
| HERAH36 | 1590 | 230462 | AL355594 | 12201 | 1–433 |
| | | | | | 464–3694 |
| HERAH36 | 1590 | 230462 | AL353731 | 12202 | 1–2229 |
| HERAH36 | 1590 | 230462 | AC073053 | 12203 | 1–433 |
| | | | | | 464–3692 |
| HERAH36 | 1590 | 230462 | AC062035 | 12204 | 1–359 |
| | | | | | 866–1512 |
| | | | | | 1770–3574 |
| HERAH36 | 1590 | 230462 | AC036204 | 12205 | 1–1345 |
| HERAH36 | 1590 | 230462 | AC027111 | 12206 | 1–6085 |
| HERAH36 | 1590 | 230462 | AC025994 | 12207 | 1–931 |
| | | | | | 1075–1292 |
| | | | | | 1316–3888 |
| HERAH36 | 1590 | 230462 | AC024532 | 12208 | 1–400 |
| HERAH36 | 1590 | 230462 | AC022526 | 12209 | 1–1937 |
| HERAH36 | 1590 | 230462 | AC012133 | 12210 | 1–359 |
| | | | | | 859–3345 |
| HERAH36 | 1590 | 230462 | AC007174 | 12211 | 1–2843 |
| | | | | | 2849–2879 |
| HERAH36 | 1590 | 230462 | AC073249 | 12212 | 1–616 |
| | | | | | 720–3953 |
| HERAH36 | 1590 | 230462 | AC069107 | 12213 | 1–1636 |
| HERAH36 | 1590 | 230462 | AC067788 | 12214 | 1–1090 |
| | | | | | 1144–1576 |
| | | | | | 1607–5262 |
| | | | | | 5430–6036 |
| HERAH36 | 1590 | 230462 | AC027005 | 12215 | 1–2877 |
| HERAH36 | 1590 | 230462 | AC026161 | 12216 | 1–5564 |
| | | | | | 5695–5779 |
| | | | | | 5824–6219 |
| | | | | | 7768–8075 |
| HERAH36 | 1590 | 230462 | AC025656 | 12217 | 1–1552 |
| HERAH36 | 1590 | 230462 | AC023435 | 12218 | 1–2256 |
| HERAH36 | 1590 | 230462 | AC019170 | 12219 | 1–4320 |
| HERAH36 | 1590 | 230462 | AL137222 | 12220 | 1–4829 |
| HERAH36 | 1590 | 230462 | AC068043 | 12221 | 1–4015 |
| HERAH36 | 1590 | 230462 | AC060811 | 12222 | 1–357 |
| | | | | | 457–3686 |
| HERAH36 | 1590 | 230462 | AC008454 | 12223 | 1–1933 |
| HERAH36 | 1590 | 230462 | AC073975 | 12224 | 1–1431 |
| HERAH36 | 1590 | 230462 | AC026189 | 12225 | 1–581 |
| HERAH36 | 1590 | 230462 | AC026052 | 12226 | 1–2455 |
| HERAH36 | 1590 | 230462 | AC024317 | 12227 | 1–299 |
| HERAH36 | 1590 | 230462 | AC021990 | 12228 | 1–2521 |
| HERAH36 | 1590 | 230462 | AC021428 | 12229 | 1–4113 |

TABLE 1C-continued

| cDNA Clone ID | SEQ ID NO: X | CONTIG ID: | BAC ID: A | SEQ ID NO: B | EXON From-To |
|---|---|---|---|---|---|
| HERAH36 | 1590 | 230462 | AL355132 | 12230 | 1–465 |
| | | | | | 713–4125 |
| | | | | | 4290–4567 |
| | | | | | 4719–4894 |
| HERAH36 | 1590 | 230462 | AL133541 | 12231 | 1–332 |
| | | | | | 455–3689 |
| HERAH36 | 1590 | 230462 | AC027262 | 12232 | 1–344 |
| | | | | | 458–3692 |
| HERAH36 | 1590 | 230462 | AC016782 | 12233 | 1–359 |
| | | | | | 464–3692 |
| HERAH36 | 1590 | 230462 | AC011164 | 12234 | 1–2400 |
| HERAH36 | 1590 | 230462 | AL355862 | 12235 | 1–552 |
| | | | | | 849–1665 |
| | | | | | 1880–2574 |
| HERAH36 | 1590 | 230462 | AL139045 | 12236 | 1–4131 |
| HERAH36 | 1590 | 230462 | AC068232 | 12237 | 1–4137 |
| HERAH36 | 1590 | 230462 | AC022949 | 12238 | 1–2383 |
| HERAH36 | 1590 | 230462 | AC022207 | 12239 | 1–432 |
| | | | | | 463–4121 |
| HERAH36 | 1590 | 230462 | AC016092 | 12240 | 1–359 |
| | | | | | 464–611 |
| | | | | | 871–1412 |
| | | | | | 1417–4114 |
| | | | | | 4711–4886 |
| | | | | | 6199–6626 |
| HERAH36 | 1590 | 230462 | AC009667 | 12241 | 1–681 |
| HERAH36 | 1590 | 230462 | AL390956 | 12242 | 1–2793 |
| HERAH36 | 1590 | 230462 | AL357332 | 12243 | 1–891 |
| | | | | | 1157–1287 |
| | | | | | 1318–1816 |
| HERAH36 | 1590 | 230462 | AL355532 | 12244 | 1–4123 |
| | | | | | 4288–4565 |
| HERAH36 | 1590 | 230462 | AL353795 | 12245 | 1–3310 |
| | | | | | 3322–4028 |
| | | | | | 4033–4549 |
| HERAH36 | 1590 | 230462 | AC063979 | 12246 | 1–2054 |
| | | | | | 2279–2945 |
| HERAH36 | 1590 | 230462 | AC007923 | 12247 | 1–4983 |
| HERAH36 | 1590 | 230462 | Z82196 | 12248 | 1–638 |
| | | | | | 956–1537 |
| HERAH36 | 1590 | 230462 | AP002531 | 12249 | 1–221 |
| HERAH36 | 1590 | 230462 | AL138743 | 12250 | 1–88 |
| HERAH36 | 1590 | 230462 | AL137022 | 12251 | 1–1084 |
| HERAH36 | 1590 | 230462 | AL136297 | 12252 | 1–391 |
| HERAH36 | 1590 | 230462 | AL136088 | 12253 | 1–1081 |
| HERAH36 | 1590 | 230462 | AL136088 | 12254 | 1–410 |
| HERAH36 | 1590 | 230462 | AL121964 | 12255 | 1–45 |
| | | | | | 1091–1303 |
| | | | | | 1453–1592 |
| | | | | | 2731–3133 |
| | | | | | 3411–3610 |
| | | | | | 4848–5171 |
| | | | | | 6281–6406 |
| | | | | | 8085–8260 |
| | | | | | 9488–9619 |
| | | | | | 11118–11201 |
| | | | | | 13489–13621 |
| | | | | | 14276–14414 |
| | | | | | 15932–16357 |
| | | | | | 17037–17623 |
| | | | | | 22852–23273 |
| | | | | | 23807–24324 |
| | | | | | 24525–25328 |
| | | | | | 29192–29595 |
| | | | | | 31597–31971 |
| | | | | | 33472–33807 |
| | | | | | 36796–37258 |
| | | | | | 37885–37990 |
| | | | | | 39786–40123 |
| | | | | | 42346–42407 |
| | | | | | 43103–43683 |
| | | | | | 44987–48124 |
| HERAH36 | 1590 | 230462 | AL121868 | 12256 | 1–302 |
| HERAH36 | 1590 | 230462 | AL121868 | 12257 | 1–686 |
| HERAH36 | 1590 | 230462 | AL109758 | 12258 | 1–453 |
| HERAH36 | 1590 | 230462 | AL109733 | 12259 | 1–376 |
| HERAH36 | 1590 | 230462 | AL109733 | 12260 | 1–905 |
| HERAH36 | 1590 | 230462 | AL096800 | 12261 | 1–1079 |
| HERAH36 | 1590 | 230462 | AL096800 | 12262 | 1–172 |
| HERAH36 | 1590 | 230462 | AL049821 | 12263 | 1–123 |
| HERAH36 | 1590 | 230462 | AL049821 | 12264 | 1–178 |
| HERAH36 | 1590 | 230462 | AL049778 | 12265 | 1–832 |
| HERAH36 | 1590 | 230462 | AL049778 | 12266 | 1–715 |
| HERAH36 | 1590 | 230462 | AL035427 | 12267 | 1–519 |
| HERAH36 | 1590 | 230462 | AL034410 | 12268 | 1–218 |
| HERAH36 | 1590 | 230462 | AL034410 | 12269 | 1–675 |
| HERAH36 | 1590 | 230462 | AL022723 | 12270 | 1–191 |
| HERAH36 | 1590 | 230462 | AF248484 | 12271 | 1–274 |
| HERAH36 | 1590 | 230462 | AF127577 | 12272 | 1–275 |
| HERAH36 | 1590 | 230462 | AC040163 | 12273 | 1–368 |
| HERAH36 | 1590 | 230462 | AC010632 | 12274 | 1–328 |
| HERAH36 | 1590 | 230462 | AC010632 | 12275 | 1–711 |
| HERAH36 | 1590 | 230462 | AC009301 | 12276 | 1–1855 |
| HERAH36 | 1590 | 230462 | AC008518 | 12277 | 1–558 |
| HERAH36 | 1590 | 230462 | AC008518 | 12278 | 1–314 |
| HERAH36 | 1590 | 230462 | AC008178 | 12279 | 1–368 |
| HERAH36 | 1590 | 230462 | AC008071 | 12280 | 1–333 |
| HERAH36 | 1590 | 230462 | AC008071 | 12281 | 1–96 |
| HERAH36 | 1590 | 230462 | AC007919 | 12282 | 1–374 |
| HERAH36 | 1590 | 230462 | AC007064 | 12283 | 1–440 |
| HERAH36 | 1590 | 230462 | AC007064 | 12284 | 1–376 |
| HERAH36 | 1590 | 230462 | AC006962 | 12285 | 1–717 |
| HERAH36 | 1590 | 230462 | AC006313 | 12286 | 1–268 |
| HERAH36 | 1590 | 230462 | AC006221 | 12287 | 1–378 |
| HERAH36 | 1590 | 230462 | AC006221 | 12288 | 1–908 |
| HERAH36 | 1590 | 230462 | AC005993 | 12289 | 1–210 |
| HERAH36 | 1590 | 230462 | AC005187 | 12290 | 1–748 |
| HERAH36 | 1590 | 230462 | AC005187 | 12291 | 1–1088 |
| HERAH36 | 1590 | 230462 | AC005157 | 12292 | 1–360 |
| HERAH36 | 1590 | 230462 | AC004460 | 12293 | 1–274 |
| | | | | | 276–625 |
| HERAH36 | 1590 | 230462 | AC003098 | 12294 | 1–199 |
| HERAH36 | 1590 | 230462 | AC003098 | 12295 | 1–389 |
| HERAH36 | 1590 | 230462 | AC002468 | 12296 | 1–148 |
| HERAH36 | 1590 | 230462 | AC002403 | 12297 | 1–608 |
| HERAH36 | 1590 | 230462 | AC002086 | 12298 | 1–88 |
| HERAH36 | 1590 | 230462 | AC002041 | 12299 | 1–141 |
| HERAH36 | 1590 | 230462 | AB045358 | 12300 | 1–559 |
| HERAH36 | 1590 | 230462 | AB042235 | 12301 | 1–221 |
| HERAH36 | 1590 | 230462 | AB023058 | 12302 | 1–171 |
| HERAH36 | 1590 | 230462 | AB014082 | 12303 | 1–710 |
| HERAH36 | 1590 | 230462 | AL354913 | 12304 | 1–193 |
| HERAH36 | 1590 | 230462 | AC037443 | 12305 | 1–302 |
| HERAH36 | 1590 | 230462 | AC037443 | 12306 | 1–171 |
| HERAH36 | 1590 | 230462 | AC019025 | 12307 | 1–218 |
| HERAH36 | 1590 | 230462 | AC019025 | 12308 | 1–1279 |
| HERAH36 | 1590 | 230462 | AC018594 | 12309 | 1–908 |
| HERAH36 | 1590 | 230462 | AC016880 | 12310 | 1–410 |
| HERAH36 | 1590 | 230462 | AC012371 | 12311 | 1–406 |
| HERAH36 | 1590 | 230462 | AL359268 | 12312 | 1–731 |
| HERAH36 | 1590 | 230462 | AL162233 | 12313 | 1–366 |
| HERAH36 | 1590 | 230462 | AC026102 | 12314 | 1–368 |
| HERAH36 | 1590 | 230462 | AC022323 | 12315 | 1–368 |
| HERAH36 | 1590 | 230462 | AL355859 | 12316 | 1–899 |
| HERAH36 | 1590 | 230462 | AC023765 | 12317 | 1–366 |
| HERAH36 | 1590 | 230462 | AC023765 | 12318 | 1–172 |
| HERAH36 | 1590 | 230462 | AC021219 | 12319 | 1–218 |
| HERAH36 | 1590 | 230462 | AC016105 | 12320 | 1–377 |
| HERAH36 | 1590 | 230462 | AC011145 | 12321 | 1–902 |
| HERAH36 | 1590 | 230462 | AC010960 | 12322 | 1–218 |
| HERAH36 | 1590 | 230462 | AC010960 | 12323 | 1–575 |
| HERAH36 | 1590 | 230462 | AL359648 | 12324 | 1–374 |
| HERAH36 | 1590 | 230462 | AL357513 | 12325 | 1–238 |
| HERAH36 | 1590 | 230462 | AL354943 | 12326 | 1–218 |
| HERAH36 | 1590 | 230462 | AL354943 | 12327 | 1–566 |
| HERAH36 | 1590 | 230462 | AL161614 | 12328 | 1–914 |
| HERAH36 | 1590 | 230462 | AL157831 | 12329 | 1–218 |
| HERAH36 | 1590 | 230462 | AC021750 | 12330 | 1–908 |
| HERAH36 | 1590 | 230462 | AC021252 | 12331 | 1–908 |
| HERAH36 | 1590 | 230462 | AC019052 | 12332 | 1–1049 |
| HERAH36 | 1590 | 230462 | AC013645 | 12333 | 1–919 |
| HERAH36 | 1590 | 230462 | AC013408 | 12334 | 1–1093 |

TABLE 1C-continued

| cDNA Clone ID | SEQ ID NO: X | CONTIG ID: | BAC ID: A | SEQ ID NO: B | EXON From-To |
|---|---|---|---|---|---|
| HERAH36 | 1590 | 230462 | AC013408 | 12335 | 1–410 |
| HERAH36 | 1590 | 230462 | AC013379 | 12336 | 1–448 |
| HERAH36 | 1590 | 230462 | AC009443 | 12337 | 1–218 |
| HERAH36 | 1590 | 230462 | AC009443 | 12338 | 1–760 |
| HERAH36 | 1590 | 230462 | AP001124 | 12339 | 1–914 |
| HERAH36 | 1590 | 230462 | AC022099 | 12340 | 1–848 |
| HERAH36 | 1590 | 230462 | AC069157 | 12341 | 1–1086 |
| HERAH36 | 1590 | 230462 | AP001992 | 12342 | 1–538 704–981 1142–1310 |
| HERAH36 | 1590 | 230462 | AP001992 | 12343 | 1–218 |
| HERAH36 | 1590 | 230462 | AL365355 | 12344 | 1–914 |
| HERAH36 | 1590 | 230462 | AL359999 | 12345 | 1–377 448–1183 |
| HERAH36 | 1590 | 230462 | AL162571 | 12346 | 1–1087 |
| HERAH36 | 1590 | 230462 | AL162571 | 12347 | 1–410 |
| HERAH36 | 1590 | 230462 | AL162256 | 12348 | 1–914 |
| HERAH36 | 1590 | 230462 | AC073625 | 12349 | 1–571 |
| HERAH36 | 1590 | 230462 | AC073625 | 12350 | 1–1098 |
| HERAH36 | 1590 | 230462 | AC025748 | 12351 | 1–218 |
| HERAH36 | 1590 | 230462 | AC010368 | 12352 | 1–902 |
| HERAH36 | 1590 | 230462 | AC026977 | 12353 | 1–3056 |
| HERAH36 | 1590 | 230462 | AP001770 | 12354 | 1–537 |
| HERAH36 | 1590 | 230462 | AL356860 | 12355 | 1–910 |
| HERAH36 | 1590 | 230462 | AL356804 | 12356 | 1–565 |
| HERAH36 | 1590 | 230462 | AL162735 | 12357 | 1–410 |
| HERAH36 | 1590 | 230462 | AL162735 | 12358 | 1–318 |
| HERAH36 | 1590 | 230462 | AC063934 | 12359 | 1–913 |
| HERAH36 | 1590 | 230462 | AC007622 | 12360 | 1–210 |
| HERAH36 | 1590 | 230462 | AC007622 | 12361 | 1–236 |
| HERAH36 | 1590 | 230462 | AC025660 | 12362 | 1–378 |
| HERAH36 | 1590 | 230462 | AL136960 | 12363 | 1–171 |
| HERAH36 | 1590 | 230462 | AC008875 | 12364 | 1–893 |
| HERAH36 | 1590 | 230462 | AC008555 | 12365 | 1–518 |
| HERAH36 | 1590 | 230462 | AL355877 | 12366 | 1–211 |
| HERAH36 | 1590 | 230462 | AC027512 | 12367 | 1–569 |
| HERAH36 | 1590 | 230462 | AC025567 | 12368 | 1–334 |
| HERAH36 | 1590 | 230462 | AP001806 | 12369 | 1–914 |
| HERAH36 | 1590 | 230462 | AP001394 | 12370 | 1–821 |
| HERAH36 | 1590 | 230462 | AP001394 | 12371 | 1–148 |
| HERAH36 | 1590 | 230462 | AP001368 | 12372 | 1–366 |
| HERAH36 | 1590 | 230462 | AL157937 | 12373 | 1–451 510–919 2793–3063 |
| HERAH36 | 1590 | 230462 | AL137863 | 12374 | 1–410 |
| HERAH36 | 1590 | 230462 | AC016748 | 12375 | 1–1087 |
| HERAH36 | 1590 | 230462 | AC073266 | 12376 | 1–1084 |
| HERAH36 | 1590 | 230462 | AC064857 | 12377 | 1–148 |
| HERAH36 | 1590 | 230462 | AC062019 | 12378 | 1–318 |
| HERAH36 | 1590 | 230462 | AC040975 | 12379 | 1–218 |
| HERAH36 | 1590 | 230462 | AC040908 | 12380 | 1–535 |
| HERAH36 | 1590 | 230462 | AC025315 | 12381 | 1–302 |
| HERAH36 | 1590 | 230462 | AC025315 | 12382 | 1–668 |
| HERAH36 | 1590 | 230462 | AL157876 | 12383 | 1–218 |
| HERAH36 | 1590 | 230462 | AC027048 | 12384 | 1–914 |
| HERAH36 | 1590 | 230462 | AC021242 | 12385 | 1–368 |
| HERAH36 | 1590 | 230462 | AC021242 | 12386 | 1–172 |
| HERAH36 | 1590 | 230462 | AC025069 | 12387 | 1–340 |
| HERAH36 | 1590 | 230462 | AC026935 | 12388 | 1–386 |
| HERAH36 | 1590 | 230462 | AL390799 | 12389 | 1–218 |
| HERAH36 | 1590 | 230462 | AL390799 | 12390 | 1–760 |
| HERAH36 | 1590 | 230462 | AL358353 | 12391 | 1–108 |
| HERAH36 | 1590 | 230462 | AL358353 | 12392 | 1–365 |
| HERAH36 | 1590 | 230462 | AL356377 | 12393 | 1–391 422–840 |
| HERAH36 | 1590 | 230462 | AL138479 | 12394 | 1–391 |
| HERAH36 | 1590 | 230462 | AL133267 | 12395 | 1–570 |
| HERAH36 | 1590 | 230462 | AL133267 | 12396 | 1–1086 |
| HERAH36 | 1590 | 230462 | AL122019 | 12397 | 1–391 422–846 |
| HERAH36 | 1590 | 230462 | AL121986 | 12398 | 1–714 |
| HERAH36 | 1590 | 230462 | AC025447 | 12399 | 1–902 |
| HERAH36 | 1590 | 230462 | AC024948 | 12400 | 1–85 |
| HERAH36 | 1590 | 230462 | AC024948 | 12401 | 1–579 |
| HERAH36 | 1590 | 230462 | AC022002 | 12402 | 1–374 |
| HERAH36 | 1590 | 230462 | AC021576 | 12403 | 1–1293 3579–3695 |
| HERAH36 | 1590 | 230462 | AC021576 | 12404 | 1–419 |
| HERAH36 | 1590 | 230462 | AC020804 | 12405 | 1–338 |
| HERAH36 | 1590 | 230462 | AC020752 | 12406 | 1–374 |
| HERAH36 | 1590 | 230462 | AC020691 | 12407 | 1–115 |
| HERAH36 | 1590 | 230462 | AC019354 | 12408 | 1–616 |
| HERAH36 | 1590 | 230462 | AC018812 | 12409 | 1–374 |
| HERAH36 | 1590 | 230462 | AC017082 | 12410 | 1–218 |
| HERAH36 | 1590 | 230462 | AC012199 | 12411 | 1–569 |
| HERAH36 | 1590 | 230462 | AC002419 | 12412 | 1–1201 1224–1326 |
| HERAH36 | 1590 | 230462 | AC013405 | 12413 | 1–538 704–981 1141–1309 |
| HERAH36 | 1590 | 230462 | AC013405 | 12414 | 1–218 |
| HERAH36 | 1590 | 230462 | AL390117 | 12415 | 1–218 |
| HERAH36 | 1590 | 230462 | AC036227 | 12416 | 1–377 448–1183 |
| HERAH36 | 1590 | 230462 | AL139288 | 12417 | 1–1084 |
| HERAH36 | 1590 | 230462 | AL355594 | 12418 | 1–1088 |
| HERAH36 | 1590 | 230462 | AC073053 | 12419 | 1–408 |
| HERAH36 | 1590 | 230462 | AC073053 | 12420 | 1–765 3209–4103 |
| HERAH36 | 1590 | 230462 | AC062035 | 12421 | 1–1075 |
| HERAH36 | 1590 | 230462 | AC027111 | 12422 | 1–1152 |
| HERAH36 | 1590 | 230462 | AC012133 | 12423 | 1–302 |
| HERAH36 | 1590 | 230462 | AC012133 | 12424 | 1–410 |
| HERAH36 | 1590 | 230462 | AC007174 | 12425 | 1–374 |
| HERAH36 | 1590 | 230462 | AC027005 | 12426 | 1–348 |
| HERAH36 | 1590 | 230462 | AC025656 | 12427 | 1–617 |
| HERAH36 | 1590 | 230462 | AC023435 | 12428 | 1–148 |
| HERAH36 | 1590 | 230462 | AC023435 | 12429 | 1–411 |
| HERAH36 | 1590 | 230462 | AC060811 | 12430 | 1–302 |
| HERAH36 | 1590 | 230462 | AC060811 | 12431 | 1–674 |
| HERAH36 | 1590 | 230462 | AC008454 | 12432 | 1–405 |
| HERAH36 | 1590 | 230462 | AC073975 | 12433 | 1–336 |
| HERAH36 | 1590 | 230462 | AC073975 | 12434 | 1–410 |
| HERAH36 | 1590 | 230462 | AC026052 | 12435 | 1–218 |
| HERAH36 | 1590 | 230462 | AC024317 | 12436 | 1–337 |
| HERAH36 | 1590 | 230462 | AC024317 | 12437 | 1–271 |
| HERAH36 | 1590 | 230462 | AC021990 | 12438 | 1–218 |
| HERAH36 | 1590 | 230462 | AC021428 | 12439 | 1–913 |
| HERAH36 | 1590 | 230462 | AL355132 | 12440 | 1–911 |
| HERAH36 | 1590 | 230462 | AL133541 | 12441 | 1–172 |
| HERAH36 | 1590 | 230462 | AL133541 | 12442 | 1–1044 |
| HERAH36 | 1590 | 230462 | AC027262 | 12443 | 1–376 |
| HERAH36 | 1590 | 230462 | AC027262 | 12444 | 1–910 |
| HERAH36 | 1590 | 230462 | AC016782 | 12445 | 1–1092 |
| HERAH36 | 1590 | 230462 | AC016782 | 12446 | 1–405 |
| HERAH36 | 1590 | 230462 | AC011164 | 12447 | 1–410 |
| HERAH36 | 1590 | 230462 | AL355862 | 12448 | 1–218 |
| HERAH36 | 1590 | 230462 | AC022949 | 12449 | 1–193 |
| HERAH36 | 1590 | 230462 | AC022207 | 12450 | 1–910 |
| HERAH36 | 1590 | 230462 | AC016092 | 12451 | 1–1052 |
| HERAH36 | 1590 | 230462 | AL390956 | 12452 | 1–302 |
| HERAH36 | 1590 | 230462 | AL357332 | 12453 | 1–238 |
| HERAH36 | 1590 | 230462 | AL355532 | 12454 | 1–914 |
| HERAH36 | 1590 | 230462 | AL353795 | 12455 | 1–134 |
| HETAM53 | 1596 | 1003026 | AC025806 | 12456 | 1–3825 |
| HETAM53 | 1596 | 1003026 | AC025806 | 12457 | 1–292 |
| HETBB70 | 1601 | 456604 | AC018634 | 12458 | 1–685 |
| HETBB70 | 1601 | 456604 | AC018634 | 12459 | 1–140 |
| HETBX14 | 1602 | 806447 | AC011473 | 12460 | 1–205 727–1286 1995–2071 2865–3025 3352–3617 4434–4573 4958–5431 |
| HETBX14 | 1602 | 806447 | AC011473 | 12461 | 1–77 241–299 745–906 1417–1520 2346–2501 2754–2852 2923–3002 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 3962–4096 |
| | | | | | 5422–5791 |
| HETCP58 | 1605 | 973133 | AC078899 | 12462 | 1–2456 |
| HETFI51 | 1612 | 566222 | AC002098 | 12463 | 1–106 |
| | | | | | 632–766 |
| | | | | | 1032–1392 |
| | | | | | 1896–2014 |
| | | | | | 2340–2921 |
| | | | | | 3822–3955 |
| HETHE81 | 1614 | 881675 | AL021917 | 12464 | 1–167 |
| | | | | | 2174–2629 |
| | | | | | 2789–2981 |
| | | | | | 2989–3082 |
| | | | | | 3330–3727 |
| | | | | | 5134–5419 |
| | | | | | 5630–5826 |
| | | | | | 6742–6958 |
| | | | | | 7694–7912 |
| | | | | | 8078–9301 |
| | | | | | 9375–13135 |
| HETJZ45 | 1620 | 1352371 | AL121756 | 12465 | 1–76 |
| | | | | | 857–999 |
| | | | | | 3340–3434 |
| | | | | | 5111–5222 |
| | | | | | 6125–6272 |
| | | | | | 7752–7812 |
| | | | | | 8649–8936 |
| | | | | | 9356–9420 |
| | | | | | 10574–10666 |
| | | | | | 10953–11138 |
| | | | | | 11377–11429 |
| | | | | | 11894–12068 |
| | | | | | 12646–12712 |
| | | | | | 12857–12903 |
| | | | | | 13597–13659 |
| | | | | | 14038–14116 |
| | | | | | 15659–16038 |
| HETJZ45 | 1620 | 1352371 | AL121756 | 12466 | 1–676 |
| HFACI31 | 1625 | 1137876 | AC024044 | 12467 | 1–1245 |
| HFACI31 | 1625 | 1137876 | AC024044 | 12468 | 1–391 |
| HFAME37 | 1628 | 1033521 | AC025965 | 12469 | 1–1927 |
| HFAME37 | 1628 | 1033521 | AC025965 | 12470 | 1–139 |
| | | | | | 147–260 |
| HFCAA91 | 1630 | 908126 | AC025410 | 12471 | 1–2250 |
| HFCAA91 | 1630 | 908126 | AP000760 | 12472 | 1–2250 |
| HFCAA91 | 1630 | 908126 | AC048373 | 12473 | 1–2250 |
| HFCAL39 | 1631 | 941953 | AC004382 | 12474 | 1–392 |
| | | | | | 1433–1524 |
| | | | | | 2045–2412 |
| | | | | | 5896–6006 |
| | | | | | 6220–6339 |
| | | | | | 6622–6745 |
| | | | | | 6860–7053 |
| | | | | | 7805–7943 |
| | | | | | 8107–10884 |
| | | | | | 11495–11891 |
| | | | | | 12090–12154 |
| | | | | | 12556–12796 |
| | | | | | 14170–14535 |
| | | | | | 14609–14739 |
| | | | | | 15621–15673 |
| | | | | | 15827–15899 |
| | | | | | 17314–17559 |
| | | | | | 18774–18819 |
| | | | | | 19038–19294 |
| | | | | | 20574–21261 |
| | | | | | 21349–22864 |
| | | | | | 22929–24012 |
| | | | | | 24033–24440 |
| | | | | | 24750–25066 |
| | | | | | 25193–25341 |
| | | | | | 26224–26728 |
| | | | | | 28008–28611 |
| | | | | | 28617–29045 |
| | | | | | 30632–30993 |
| | | | | | 34265–34367 |
| HFCAL39 | 1631 | 941953 | AC004382 | 12475 | 1–282 |
| HFCAL39 | 1631 | 941953 | AC004382 | 12476 | 1–352 |
| | | | | | 1344–1612 |
| | | | | | 1804–2096 |
| HFCEP45 | 1639 | 1009071 | AC011792 | 12477 | 1–405 |
| HFCEP45 | 1639 | 1009071 | AC023457 | 12478 | 1–405 |
| HFCEP45 | 1639 | 1009071 | AC023457 | 12479 | 1–405 |
| HFEBP27 | 1652 | 1043268 | AC011976 | 12480 | 1–131 |
| | | | | | 1354–1474 |
| | | | | | 2041–2315 |
| HFIDQ92 | 1668 | 1045310 | AC023242 | 12481 | 1–86 |
| HFIDQ92 | 1668 | 1045310 | AC016327 | 12482 | 1–165 |
| HFIDQ92 | 1668 | 1045310 | AC009453 | 12483 | 1–143 |
| HFIDQ92 | 1668 | 1045310 | AC022231 | 12484 | 1–151 |
| HFIDQ92 | 1668 | 1045310 | AC016327 | 12485 | 1–195 |
| HFITF82 | 1673 | 992842 | AC072032 | 12486 | 1–364 |
| HFITF82 | 1673 | 992842 | AC002518 | 12487 | 1–247 |
| HFITF82 | 1673 | 992842 | AC022305 | 12488 | 1–686 |
| HFITF82 | 1673 | 992842 | AC078916 | 12489 | 1–364 |
| HFITF82 | 1673 | 992842 | AC072032 | 12490 | 1–288 |
| HFITF82 | 1673 | 992842 | AC078916 | 12491 | 1–288 |
| HFKEE48 | 1686 | 846318 | AC022494 | 12492 | 1–292 |
| | | | | | 390–1012 |
| HFKFL92 | 1694 | 1105705 | AC018785 | 12493 | 1–1207 |
| HFKFL92 | 1694 | 1105705 | AC037465 | 12494 | 1–1207 |
| HFKFL92 | 1694 | 1105705 | AC018785 | 12495 | 1–56 |
| | | | | | 1149–1237 |
| | | | | | 1794–1905 |
| | | | | | 3557–3901 |
| HFKFL92 | 1694 | 1105705 | AC037465 | 12496 | 1–95 |
| | | | | | 3647–4150 |
| | | | | | 4409–4618 |
| | | | | | 5856–6037 |
| | | | | | 6860–7011 |
| | | | | | 7132–7266 |
| | | | | | 7946–8044 |
| | | | | | 8265–8377 |
| | | | | | 8558–8639 |
| | | | | | 9625–9804 |
| | | | | | 10001–10171 |
| | | | | | 10975–11186 |
| | | | | | 11796–11957 |
| | | | | | 12637–14518 |
| | | | | | 14866–14980 |
| | | | | | 15836–15857 |
| HFKFL92 | 1694 | 1105705 | AC037465 | 12497 | 1–56 |
| | | | | | 1149–1237 |
| | | | | | 1794–1905 |
| | | | | | 3556–3900 |
| HFKLX38 | 1701 | 1132442 | AL136383 | 12498 | 1–32 |
| | | | | | 1288–1454 |
| | | | | | 1561–1646 |
| | | | | | 3840–4700 |
| | | | | | 5482–6798 |
| HFLSH80 | 1703 | 1068711 | AC021591 | 12499 | 1–190 |
| | | | | | 298–563 |
| | | | | | 980–1113 |
| | | | | | 1197–1367 |
| | | | | | 1445–1661 |
| | | | | | 1767–1929 |
| | | | | | 2007–2155 |
| | | | | | 2213–2821 |
| | | | | | 2897–4727 |
| | | | | | 4817–4911 |
| | | | | | 4925–5846 |
| | | | | | 5861–6731 |
| | | | | | 6733–7188 |
| | | | | | 7233–7340 |
| | | | | | 7496–7582 |
| | | | | | 7940–8071 |
| | | | | | 8271–8408 |
| | | | | | 9521–9579 |
| | | | | | 9786–9871 |
| | | | | | 10020–10848 |
| | | | | | 11712–11823 |
| | | | | | 12593–12670 |

TABLE 1C-continued

| cDNA Clone ID | SEQ ID NO: X | CONTIG ID: | BAC ID: A | SEQ ID NO: B | EXON From-To |
|---|---|---|---|---|---|
| HFLSH80 | 1703 | 1068711 | AC021591 | 12500 | 13206–13292<br>1–102<br>1937–2077<br>7202–7303 |
| HFLSH80 | 1703 | 1068711 | AC021591 | 12501 | 1–227<br>2808–3194<br>3438–3607<br>5003–5159<br>5369–5634<br>6412–6799<br>7330–7454<br>7809–7918<br>8505–9252 |
| HFPBW41 | 1715 | 516314 | AC027530 | 12502 | 1–1132 |
| HFPBW41 | 1715 | 516314 | AC027530 | 12503 | 1–296 |
| HFPBW41 | 1715 | 516314 | AC027530 | 12504 | 1–348 |
| HFPHB92 | 1727 | 1046028 | AC007246 | 12505 | 1–949<br>4972–5006 |
| HFXAX45 | 1757 | 863233 | AC016764 | 12506 | 1–1587 |
| HFXBJ12 | 1758 | 1092336 | Z98886 | 12507 | 1–1131 |
| HFXBJ12 | 1758 | 1092336 | AC023100 | 12508 | 1–1131 |
| HFXBJ12 | 1758 | 1092336 | Z98886 | 12509 | 1–431 |
| HFXBJ12 | 1758 | 1092336 | AC023100 | 12510 | 1–431 |
| HFXBS68 | 1761 | 1015942 | AC005215 | 12511 | 1–2450 |
| HFXBS68 | 1761 | 1015942 | AC010317 | 12512 | 1–2448 |
| HFXBS68 | 1761 | 1015942 | AC005215 | 12513 | 1–661 |
| HFXBS68 | 1761 | 1015942 | AC010317 | 12514 | 1–661 |
| HFXDI56 | 1767 | 1218288 | AL354751 | 12515 | 1–1031 |
| HFXDI56 | 1767 | 1218288 | AL117340 | 12516 | 1–1051 |
| HFXDI56 | 1767 | 1218288 | AC018554 | 12517 | 1–1046 |
| HFXDI56 | 1767 | 1218288 | AL158080 | 12518 | 1–1051 |
| HFXDI56 | 1767 | 1218288 | AL355148 | 12519 | 1–1051 |
| HFXDI56 | 1767 | 1218288 | AL354751 | 12520 | 1–455 |
| HFXDI56 | 1767 | 1218288 | AL117340 | 12521 | 1–442 |
| HFXDI56 | 1767 | 1218288 | AL117340 | 12522 | 1–722 |
| HFXDI56 | 1767 | 1218288 | AC018554 | 12523 | 1–825 |
| HFXDI56 | 1767 | 1218288 | AL158080 | 12524 | 1–442 |
| HFXDI56 | 1767 | 1218288 | AL158080 | 12525 | 1–722 |
| HFXDI56 | 1767 | 1218288 | AL355148 | 12526 | 1–442 |
| HFXDI56 | 1767 | 1218288 | AL355148 | 12527 | 1–722 |
| HFXFH04 | 1775 | 974983 | AC008000 | 12528 | 1–1567 |
| HFXFH04 | 1775 | 974983 | AC012515 | 12529 | 1–1567 |
| HFXFH04 | 1775 | 974983 | AC012600 | 12530 | 1–1567 |
| HFXHM17 | 1782 | 1042595 | AC011995 | 12531 | 1–1286 |
| HFXHM17 | 1782 | 1042595 | AC017056 | 12532 | 1–2809 |
| HFXHM17 | 1782 | 1042595 | AC011995 | 12533 | 1–913<br>1014–1110 |
| HGBAR55 | 1799 | 1164884 | AC009477 | 12534 | 1–3616 |
| HGBAR55 | 1799 | 1164884 | AC009477 | 12535 | 1–1218<br>1805–2243<br>2711–2957<br>3670–3804<br>5055–5771<br>5791–6797<br>6814–6995<br>7064–7096 |
| HGBAR55 | 1799 | 1164884 | AC009477 | 12536 | 1–224 |
| HGBDH53 | 1802 | 848274 | AC005369 | 12537 | 1–649<br>870–1459<br>2153–2236<br>2499–2621<br>2722–2856<br>3368–3523<br>4084–4227<br>4315–4423<br>4652–4777<br>5094–5193<br>5519–5647<br>5739–5983<br>6144–6260<br>6507–6661<br>7019–8042<br>8949–9295<br>9392–9485<br>10579–10703<br>11915–11969<br>11976–12107<br>12491–12570<br>12627–13146<br>14186–15261 |
| HGBDH53 | 1802 | 848274 | AC005369 | 12538 | 1–109 |
| HGBDH53 | 1802 | 848274 | AC005369 | 12539 | 1–86<br>357–503 |
| HGBHK46 | 1807 | 340831 | AC010757 | 12540 | 1–2699<br>3108–3409<br>3448–4191<br>4469–4606<br>5238–5353<br>5575–5864<br>5976–6135<br>6405–6495<br>7378–7694<br>8221–8651<br>9260–9548<br>11095–11192<br>11253–11765<br>12877–13746<br>15389–15794<br>18586–18765<br>19115–19435<br>19521–19697<br>19699–21477 |
| HGBHK46 | 1807 | 340831 | AC012291 | 12541 | 1–2699<br>3108–3409<br>3448–4191<br>4469–4606<br>5238–5353<br>5575–5864<br>5976–6135<br>6405–6495<br>7378–7694<br>8222–8665<br>9260–9548<br>11097–11194<br>11255–11767<br>12879–13748<br>15390–15795<br>16691–17309<br>18589–18768<br>19118–19438<br>19524–19700<br>19703–21480 |
| HGBHK46 | 1807 | 340831 | AC010757 | 12542 | 1–1855 |
| HGBHK46 | 1807 | 340831 | AC012291 | 12543 | 1–1855 |
| HGCNC48 | 1813 | 1094388 | AC003998 | 12544 | 1–332<br>3099–3419<br>11899–13279<br>17401–17694<br>19978–20303<br>25961–26241 |
| HGCNC48 | 1813 | 1094388 | AC011833 | 12545 | 1–1381<br>1–501 |
| HGCNC48 | 1813 | 1094388 | AC003998 | 12546 | 1–501 |
| HGLAJ51 | 1814 | 847108 | AC027084 | 12547 | 1–3527<br>3609–4648<br>4692–6103<br>6174–6303<br>7688–8231<br>9260–9334<br>10758–11257<br>12293–13151<br>13597–13635<br>13730–13859<br>18353–18453<br>19614–20295 |
| HGLAJ51 | 1814 | 847108 | AC027084 | 12548 | 1–123<br>336–708 |
| HGLAJ51 | 1814 | 847108 | AC027084 | 12549 | 1–270 |
| HHBGF77 | 1826 | 941990 | AL355356 | 12550 | 1–1069 |
| HHBGF77 | 1826 | 941990 | AL355312 | 12551 | 1–1700 |
| HHENZ16 | 1839 | 911172 | AL118513 | 12552 | 1–2302 |
| HHENZ16 | 1839 | 911172 | AL118513 | 12553 | 1–530 |
| HHEPG23 | 1841 | 1034541 | AC068015 | 12554 | 1–348 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 1274–1562 |
| | | | | | 1985–2125 |
| | | | | | 2454–3314 |
| | | | | | 3547–7786 |
| HHEPG23 | 1841 | 1034541 | AC010366 | 12555 | 1–997 |
| | | | | | 1106–1316 |
| | | | | | 1335–1913 |
| | | | | | 2919–3266 |
| | | | | | 4175–4478 |
| | | | | | 4903–5043 |
| | | | | | 5372–6232 |
| | | | | | 6465–10705 |
| | | | | | 11021–11341 |
| | | | | | 11720–12565 |
| | | | | | 13676–14141 |
| | | | | | 17560–17603 |
| HHEPG23 | 1841 | 1034541 | AC068015 | 12556 | 1–579 |
| HHESQ62 | 1847 | 1032630 | AL137002 | 12557 | 1–351 |
| | | | | | 374–3908 |
| HHESQ62 | 1847 | 1032630 | AL136221 | 12558 | 1–352 |
| | | | | | 375–5189 |
| | | | | | 5430–5504 |
| | | | | | 5561–6212 |
| | | | | | 7016–7428 |
| | | | | | 8677–9326 |
| | | | | | 9386–10646 |
| | | | | | 10877–11430 |
| | | | | | 11513–12720 |
| | | | | | 12807–12875 |
| | | | | | 13114–13677 |
| | | | | | 13826–15376 |
| | | | | | 15415–15535 |
| HHESQ62 | 1847 | 1032630 | AL137002 | 12559 | 1–541 |
| HHESQ62 | 1847 | 1032630 | AL136221 | 12560 | 1–253 |
| HHESQ62 | 1847 | 1032630 | AL136221 | 12561 | 1–409 |
| HHFCJ31 | 1852 | 456462 | AC012170 | 12562 | 1–4102 |
| HHFCJ31 | 1852 | 456462 | AC012170 | 12563 | 1–619 |
| HHFCW75 | 1854 | 1028775 | AC016482 | 12564 | 1–1822 |
| HHFCZ67 | 1856 | 988942 | AL096870 | 12565 | 1–272 |
| | | | | | 628–951 |
| | | | | | 2881–3023 |
| | | | | | 3168–3884 |
| | | | | | 4244–4718 |
| | | | | | 4987–5111 |
| | | | | | 5782–6745 |
| | | | | | 6972–8624 |
| | | | | | 8763–9167 |
| HHFCZ67 | 1856 | 988942 | AL096870 | 12566 | 1–308 |
| HHFDH56 | 1859 | 858052 | AC027277 | 12567 | 1–968 |
| HHFDH56 | 1859 | 858052 | AC016139 | 12568 | 1–968 |
| HHFDH56 | 1859 | 858052 | AC027277 | 12569 | 1–364 |
| HHFDH56 | 1859 | 858052 | AC027277 | 12570 | 1–289 |
| HHFDH56 | 1859 | 858052 | AC016139 | 12571 | 1–289 |
| HHFDH56 | 1859 | 858052 | AC016139 | 12572 | 1–364 |
| HHFFU55 | 1864 | 871904 | AC004611 | 12573 | 1–251 |
| | | | | | 1382–1472 |
| | | | | | 5771–6133 |
| | | | | | 6295–6359 |
| | | | | | 6442–6650 |
| | | | | | 7826–8347 |
| | | | | | 9254–9316 |
| | | | | | 10212–12376 |
| | | | | | 12559–12787 |
| | | | | | 15502–15783 |
| | | | | | 16110–16487 |
| | | | | | 17335–17665 |
| | | | | | 17840–17998 |
| | | | | | 18083–18197 |
| | | | | | 19251–19627 |
| | | | | | 20272–20583 |
| | | | | | 20698–20973 |
| | | | | | 22520–22651 |
| | | | | | 23894–23987 |
| | | | | | 24090–24439 |
| | | | | | 25193–27420 |
| | | | | | 27632–28282 |
| | | | | | 28565–29505 |
| | | | | | 29889–30034 |
| | | | | | 30439–31506 |
| | | | | | 32363–32503 |
| | | | | | 33275–33618 |
| | | | | | 33760–33872 |
| | | | | | 33926–34344 |
| | | | | | 34798–34914 |
| | | | | | 35011–35078 |
| | | | | | 35152–35799 |
| HHFFU55 | 1864 | 871904 | AC004611 | 12574 | 1–104 |
| HHFFU55 | 1864 | 871904 | AC004611 | 12575 | 1–88 |
| | | | | | 1627–1799 |
| | | | | | 3095–3345 |
| HHFGA11 | 1865 | 664489 | AP002815 | 12576 | 1–254 |
| | | | | | 729–1435 |
| | | | | | 1604–1644 |
| | | | | | 4190–4848 |
| | | | | | 6363–6730 |
| | | | | | 6813–7050 |
| | | | | | 9654–10680 |
| HHFGA11 | 1865 | 664489 | AP002815 | 12577 | 1–160 |
| HHFLH45 | 1874 | 1009252 | AC004877 | 12578 | 1–175 |
| | | | | | 342–474 |
| | | | | | 573–1883 |
| | | | | | 2536–2632 |
| | | | | | 2831–2894 |
| | | | | | 2999–3231 |
| | | | | | 5032–5164 |
| | | | | | 6664–6820 |
| | | | | | 7288–7881 |
| HHFLH45 | 1874 | 1009252 | AC004877 | 12579 | 1–42 |
| | | | | | 1197–1333 |
| | | | | | 1575–1698 |
| | | | | | 1936–1984 |
| | | | | | 2246–2304 |
| HHFUC40 | 1877 | 1037934 | AC073842 | 12580 | 1–165 |
| HHFUC40 | 1877 | 1037934 | AC009896 | 12581 | 1–4778 |
| HHFUC40 | 1877 | 1037934 | AC013583 | 12582 | 1–133 |
| HHFUC40 | 1877 | 1037934 | AC011116 | 12583 | 1–106 |
| HHFUC40 | 1877 | 1037934 | AC009896 | 12584 | 1–342 |
| HHGAS83 | 1878 | 770164 | AC003688 | 12585 | 1–792 |
| | | | | | 1165–1313 |
| | | | | | 1365–2295 |
| HHGAS83 | 1878 | 770164 | AC026954 | 12586 | 1–792 |
| | | | | | 1165–1313 |
| | | | | | 1365–2299 |
| HHGAS83 | 1878 | 770164 | AC003688 | 12587 | 1–816 |
| | | | | | 899–1958 |
| | | | | | 2360–2454 |
| | | | | | 2606–2635 |
| | | | | | 3036–3220 |
| | | | | | 4203–4480 |
| | | | | | 4558–4682 |
| HHGAS83 | 1878 | 770164 | AC003688 | 12588 | 1–954 |
| | | | | | 961–1049 |
| | | | | | 1117–1453 |
| | | | | | 2438–2559 |
| | | | | | 2666–2783 |
| | | | | | 3197–3276 |
| | | | | | 3471–3596 |
| | | | | | 3691–3756 |
| | | | | | 3881–4020 |
| | | | | | 7608–8056 |
| HHGAS83 | 1878 | 770164 | AC026954 | 12589 | 1–554 |
| HHGBC54 | 1880 | 470709 | AC013355 | 12590 | 1–444 |
| HHGBK24 | 1882 | 396499 | AL133163 | 12591 | 1–941 |
| HHGBK24 | 1882 | 396499 | AL133163 | 12592 | 1–419 |
| HHGBK24 | 1882 | 396499 | AL133163 | 12593 | 1–100 |
| HHGDE24 | 1893 | 912267 | AC023120 | 12594 | 1–3700 |
| | | | | | 3770–4651 |
| | | | | | 4850–6149 |
| HHGDE24 | 1893 | 912267 | AC023120 | 12595 | 1–475 |
| HHLAB61 | 1899 | 535998 | AC036168 | 12596 | 1–976 |
| HHLAB61 | 1899 | 535998 | AC021752 | 12597 | 1–976 |
| HHNAB56 | 1903 | 911933 | AC027275 | 12598 | 1–86 |

TABLE 1C-continued

| cDNA Clone ID | SEQ ID NO: X | CONTIG ID: | BAC ID: A | SEQ ID NO: B | EXON From-To |
|---|---|---|---|---|---|
| HHNAB56 | 1903 | 911933 | AC008785 | 12599 | 92–1753 |
| | | | | | 1–825 |
| | | | | | 835–1811 |
| HHNAB56 | 1903 | 911933 | AC027275 | 12600 | 1–1002 |
| HHNAB56 | 1903 | 911933 | AC008785 | 12601 | 1–1000 |
| HHPDV90 | 1905 | 963213 | AC002364 | 12602 | 1–2155 |
| HHPDV90 | 1905 | 963213 | AC002364 | 12603 | 1–77 |
| | | | | | 762–848 |
| | | | | | 1852–2045 |
| | | | | | 3720–3900 |
| | | | | | 4296–4445 |
| | | | | | 5053–6857 |
| | | | | | 10053–10332 |
| | | | | | 12369–12457 |
| | | | | | 14443–15111 |
| | | | | | 15152–15283 |
| | | | | | 15913–16228 |
| | | | | | 16289–16651 |
| | | | | | 16931–18053 |
| HHPDW05 | 1906 | 1310946 | AC025545 | 12604 | 1–1446 |
| HHPDW05 | 1906 | 1310946 | AC069523 | 12605 | 1–92 |
| | | | | | 1872–1979 |
| | | | | | 2696–3121 |
| | | | | | 3520–4422 |
| | | | | | 5189–5303 |
| | | | | | 6073–6225 |
| | | | | | 7536–7893 |
| | | | | | 11391–12835 |
| HHPDW05 | 1906 | 1310946 | AC069523 | 12606 | 1–260 |
| HHSDI68 | 1915 | 422810 | AC032035 | 12607 | 1–792 |
| HHSDI68 | 1915 | 422810 | AC032035 | 12608 | 1–640 |
| HHTMM10 | 1923 | 395911 | AC026221 | 12609 | 1–747 |
| HHTMM10 | 1923 | 395911 | AC026221 | 12610 | 1–176 |
| HHTMM10 | 1923 | 395911 | AC026221 | 12611 | 1–602 |
| HIBCO28 | 1929 | 230154 | AL136089 | 12612 | 1–3070 |
| HIBCO28 | 1929 | 230154 | AL135840 | 12613 | 1–290 |
| | | | | | 932–1558 |
| | | | | | 2652–2823 |
| | | | | | 3164–6234 |
| HIBCO28 | 1929 | 230154 | AL136089 | 12614 | 1–1988 |
| HIBCO28 | 1929 | 230154 | AL135840 | 12615 | 1–1989 |
| HIBEB47 | 1931 | 1038485 | AC018635 | 12616 | 1–2510 |
| HIBEB47 | 1931 | 1038485 | AC018635 | 12617 | 1–621 |
| HILCG67 | 1935 | 422841 | AC006064 | 12618 | 1–78 |
| | | | | | 361–417 |
| | | | | | 561–808 |
| | | | | | 913–1097 |
| | | | | | 1394–1530 |
| | | | | | 2288–2401 |
| | | | | | 2442–2576 |
| | | | | | 4543–4680 |
| | | | | | 4750–4873 |
| | | | | | 5056–5206 |
| | | | | | 7114–7312 |
| | | | | | 7649–7791 |
| | | | | | 7863–7971 |
| | | | | | 8065–8251 |
| | | | | | 9179–9471 |
| | | | | | 9659–10154 |
| | | | | | 11266–11397 |
| | | | | | 12082–12334 |
| | | | | | 13109–13288 |
| | | | | | 13545–13632 |
| | | | | | 14118–14386 |
| | | | | | 14850–14950 |
| | | | | | 15869–16002 |
| | | | | | 16353–16486 |
| | | | | | 16571–16658 |
| | | | | | 16732–16901 |
| | | | | | 17177–17349 |
| | | | | | 18061–18178 |
| | | | | | 18253–18377 |
| | | | | | 18457–18615 |
| | | | | | 18958–19152 |
| | | | | | 19232–19389 |
| | | | | | 19808–19878 |
| | | | | | 20060–20245 |
| | | | | | 20461–20870 |
| | | | | | 20975–21108 |
| | | | | | 21181–21600 |
| | | | | | 21611–22253 |
| HILCG67 | 1935 | 422841 | AC006064 | 12619 | 1–86 |
| HISBF60 | 1941 | 1043144 | AC004889 | 12620 | 1–622 |
| | | | | | 2363–6063 |
| HISBF60 | 1941 | 1043144 | AC074386 | 12621 | 1–622 |
| | | | | | 2363–6063 |
| HISBF60 | 1941 | 1043144 | AC004889 | 12622 | 1–1213 |
| HISBF60 | 1941 | 1043144 | AC004889 | 12623 | 1–93 |
| HISBF60 | 1941 | 1043144 | AC074386 | 12624 | 1–93 |
| HISBF60 | 1941 | 1043144 | AC074386 | 12625 | 1–1213 |
| HISBL03 | 1942 | 843032 | AC021551 | 12626 | 1–1891 |
| HISES66 | 1949 | 1352417 | AC008791 | 12627 | 1–2541 |
| HISES66 | 1949 | 1352417 | AC020924 | 12628 | 1–2541 |
| HJPCR70 | 1975 | 989972 | AP000337 | 12629 | 1–402 |
| | | | | | 479–1423 |
| | | | | | 1426–2223 |
| HJPCR70 | 1975 | 989972 | AP000215 | 12630 | 1–118 |
| | | | | | 771–1413 |
| | | | | | 2342–4887 |
| | | | | | 4890–5687 |
| HJPCR70 | 1975 | 989972 | AP000337 | 12631 | 1–521 |
| HJPCR70 | 1975 | 989972 | AP000215 | 12632 | 1–226 |
| HJPCR70 | 1975 | 989972 | AP000215 | 12633 | 1–521 |
| HJPDJ64 | 1978 | 396079 | AC027116 | 12634 | 1–417 |
| | | | | | 1542–1883 |
| | | | | | 2547–2644 |
| | | | | | 3234–3317 |
| | | | | | 4045–4387 |
| | | | | | 4561–4942 |
| | | | | | 5029–5287 |
| | | | | | 6230–6850 |
| | | | | | 6936–7598 |
| | | | | | 7713–8015 |
| | | | | | 8248–8896 |
| HJPDJ64 | 1978 | 396079 | AC021329 | 12635 | 1–417 |
| | | | | | 1542–1883 |
| | | | | | 2547–2644 |
| | | | | | 3234–3317 |
| | | | | | 4045–4387 |
| | | | | | 4561–4942 |
| | | | | | 5029–5287 |
| | | | | | 6230–6850 |
| | | | | | 6936–7597 |
| | | | | | 7712–8014 |
| | | | | | 8247–8895 |
| HJPDJ64 | 1978 | 396079 | AC027116 | 12636 | 1–5853 |
| | | | | | 5877–7569 |
| HJPDJ64 | 1978 | 396079 | AC021329 | 12637 | 1–5853 |
| | | | | | 5877–7569 |
| HKAAV61 | 1981 | 1035509 | AC021391 | 12638 | 1–188 |
| | | | | | 698–830 |
| | | | | | 1106–1166 |
| | | | | | 2402–2830 |
| | | | | | 3017–3120 |
| | | | | | 3498–3643 |
| | | | | | 4309–5660 |
| | | | | | 6001–6117 |
| | | | | | 6335–6429 |
| | | | | | 6528–6659 |
| | | | | | 7603–7856 |
| | | | | | 8063–8290 |
| | | | | | 8393–8998 |
| | | | | | 9090–9262 |
| | | | | | 9597–9775 |
| | | | | | 9796–9937 |
| | | | | | 10222–10412 |
| | | | | | 10599–10749 |
| | | | | | 11184–11381 |
| | | | | | 11527–11925 |
| | | | | | 12377–12458 |
| HKABW11 | 1984 | 926717 | AL049829 | 12639 | 1–58 |
| | | | | | 356–442 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 923–1364 |
| | | | | | 1981–5109 |
| HKABW11 | 1984 | 926717 | AL049829 | 12640 | 1–247 |
| HKGBH24 | 2022 | 1056244 | AC011301 | 12641 | 1–3619 |
| HKGBJ74 | 2023 | 1189265 | AP001337 | 12642 | 1–1455 |
| HKGBJ74 | 2023 | 1189265 | AP001337 | 12643 | 1–705 |
| HKGBS01 | 2024 | 852455 | AC008953 | 12644 | 1–59 |
| | | | | | 1063–4453 |
| | | | | | 4567–4689 |
| | | | | | 4704–5224 |
| | | | | | 6073–6807 |
| | | | | | 7646–8157 |
| | | | | | 9805–9867 |
| | | | | | 10403–10578 |
| | | | | | 11730–12316 |
| | | | | | 13203–13577 |
| | | | | | 14138–14233 |
| | | | | | 14404–15032 |
| | | | | | 15055–15370 |
| | | | | | 15417–15644 |
| | | | | | 15818–15962 |
| | | | | | 16154–16386 |
| | | | | | 16420–16547 |
| | | | | | 17124–17299 |
| | | | | | 17340–18333 |
| | | | | | 19149–19237 |
| | | | | | 20478–20591 |
| | | | | | 20717–20885 |
| | | | | | 20952–21044 |
| | | | | | 23799–23900 |
| | | | | | 24393–24492 |
| | | | | | 24905–25157 |
| | | | | | 25709–26467 |
| | | | | | 26497–26811 |
| | | | | | 26844–27515 |
| | | | | | 28314–28415 |
| | | | | | 29011–29429 |
| | | | | | 31051–31127 |
| HKGBS01 | 2024 | 852455 | AC035140 | 12645 | 1–59 |
| | | | | | 1070–4446 |
| | | | | | 4562–4643 |
| | | | | | 4697–5217 |
| HKGBS01 | 2024 | 852455 | AC008953 | 12646 | 1–902 |
| HKGBS01 | 2024 | 852455 | AC035140 | 12647 | 1–735 |
| HKGBS01 | 2024 | 852455 | AC035140 | 12648 | 1–901 |
| HKLSA57 | 2044 | 420002 | AL353642 | 12649 | 1–31 |
| | | | | | 546–1166 |
| | | | | | 1227–1320 |
| | | | | | 1599–1748 |
| | | | | | 2044–2300 |
| HKLSA57 | 2044 | 420002 | AC016134 | 12650 | 1–31 |
| | | | | | 545–1165 |
| | | | | | 1226–1319 |
| | | | | | 1598–1747 |
| | | | | | 2043–2300 |
| HKLSA57 | 2044 | 420002 | AL353642 | 12651 | 1–34 |
| | | | | | 264–540 |
| HKLSA57 | 2044 | 420002 | AC016134 | 12652 | 1–501 |
| HKLSA57 | 2044 | 420002 | AC016134 | 12653 | 1–300 |
| HKMLH01 | 2046 | 494116 | AC064851 | 12654 | 1–42 |
| | | | | | 915–1057 |
| | | | | | 1167–1633 |
| | | | | | 2254–2484 |
| | | | | | 3637–7666 |
| | | | | | 7672–7821 |
| | | | | | 7877–10024 |
| HKMLH01 | 2046 | 494116 | AC064851 | 12655 | 1–188 |
| HKMLH01 | 2046 | 494116 | AC064851 | 12656 | 1–413 |
| | | | | | 1767–2068 |
| HKPAD17 | 2056 | 526754 | AC004132 | 12657 | 1–113 |
| | | | | | 693–813 |
| | | | | | 2897–4045 |
| HKPAD17 | 2056 | 526754 | AC018740 | 12658 | 1–280 |
| | | | | | 942–1052 |
| HKPAD17 | 2056 | 526754 | AC069483 | 12659 | 1–300 |
| HKPAD17 | 2056 | 526754 | AC019092 | 12660 | 1–184 |
| HKPAD17 | 2056 | 526754 | AC024337 | 12661 | 1–235 |
| HKPAD17 | 2056 | 526754 | AC009899 | 12662 | 1–175 |
| HKPAD17 | 2056 | 526754 | AC027546 | 12663 | 1–296 |
| HKPAD17 | 2056 | 526754 | AC012201 | 12664 | 1–150 |
| HKPAD17 | 2056 | 526754 | AC022091 | 12665 | 1–267 |
| HKPAD17 | 2056 | 526754 | AC016630 | 12666 | 1–246 |
| HKPAD17 | 2056 | 526754 | AC023309 | 12667 | 1–193 |
| HKPAD17 | 2056 | 526754 | AC011767 | 12668 | 1–294 |
| HKPAD17 | 2056 | 526754 | AC024475 | 12669 | 1–187 |
| HKPAD17 | 2056 | 526754 | AC067779 | 12670 | 1–246 |
| HKPAD17 | 2056 | 526754 | AC068682 | 12671 | 1–153 |
| HKPAD17 | 2056 | 526754 | AL157775 | 12672 | 1–280 |
| HKPAD17 | 2056 | 526754 | AC034243 | 12673 | 1–312 |
| | | | | | 2334–2364 |
| HKPAD17 | 2056 | 526754 | AC015604 | 12674 | 1–261 |
| HKPAD17 | 2056 | 526754 | AC011036 | 12675 | 1–193 |
| HKPAD17 | 2056 | 526754 | AC072051 | 12676 | 1–310 |
| HKPAD17 | 2056 | 526754 | AL353577 | 12677 | 1–279 |
| HKPAD17 | 2056 | 526754 | AC055119 | 12678 | 1–320 |
| HKPAD17 | 2056 | 526754 | AC022795 | 12679 | 1–300 |
| HKPAD17 | 2056 | 526754 | AL355975 | 12680 | 1–322 |
| HKPAD17 | 2056 | 526754 | AC027414 | 12681 | 1–270 |
| HKPAD17 | 2056 | 526754 | AC025388 | 12682 | 1–296 |
| HKPAD17 | 2056 | 526754 | AC004132 | 12683 | 1–158 |
| HKPAD17 | 2056 | 526754 | AC019092 | 12684 | 1–268 |
| HKPAD17 | 2056 | 526754 | AC016630 | 12685 | 1–131 |
| HKPAD17 | 2056 | 526754 | AC011767 | 12686 | 1–2519 |
| | | | | | 2706–3086 |
| HKPAD17 | 2056 | 526754 | AC067779 | 12687 | 1–1558 |
| | | | | | 1589–4706 |
| HKZAH22 | 2060 | 1125739 | AL034424 | 12688 | 1–123 |
| | | | | | 939–1565 |
| | | | | | 2801–2938 |
| | | | | | 3519–3720 |
| | | | | | 6154–6361 |
| | | | | | 6365–8530 |
| HKZAH22 | 2060 | 1125739 | AC073619 | 12689 | 1–123 |
| | | | | | 939–1565 |
| | | | | | 2806–2942 |
| | | | | | 3523–3724 |
| | | | | | 6157–6364 |
| | | | | | 6368–8537 |
| HKZAO35 | 2061 | 1115012 | AC024564 | 12690 | 1–530 |
| HKZAO35 | 2061 | 1115012 | AC010293 | 12691 | 1–68 |
| | | | | | 686–809 |
| | | | | | 1912–2006 |
| | | | | | 4676–4771 |
| | | | | | 4992–5640 |
| | | | | | 6047–6192 |
| | | | | | 9091–9481 |
| | | | | | 9762–11348 |
| | | | | | 13141–13669 |
| | | | | | 14220–14387 |
| | | | | | 16251–16623 |
| | | | | | 16655–17121 |
| HKZAO35 | 2061 | 1115012 | AC024564 | 12692 | 1–93 |
| | | | | | 2773–2860 |
| | | | | | 3089–3737 |
| | | | | | 4144–4286 |
| | | | | | 7194–7583 |
| | | | | | 7864–9450 |
| HKZAO35 | 2061 | 1115012 | AC024564 | 12693 | 1–149 |
| HKZAO35 | 2061 | 1115012 | AC010293 | 12694 | 1–463 |
| HKZAS29 | 2062 | 1113382 | AP001357 | 12695 | 1–2531 |
| HKZAS29 | 2062 | 1113382 | AC067860 | 12696 | 1–912 |
| HKZCK47 | 2064 | 1045503 | AL133542 | 12697 | 1–193 |
| | | | | | 3143–4534 |
| | | | | | 4683–5097 |
| HKZCK47 | 2064 | 1045503 | AL133542 | 12698 | 1–143 |
| HKZCK47 | 2064 | 1045503 | AL133542 | 12699 | 1–408 |
| HLCAA05 | 2070 | 786434 | AL354726 | 12700 | 1–690 |
| | | | | | 1232–1538 |
| | | | | | 3245–4750 |
| HLCAA05 | 2070 | 786434 | AC015928 | 12701 | 1–690 |
| | | | | | 1223–1539 |
| | | | | | 3246–4751 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 5930–6030 |
| | | | | | 9381–9477 |
| | | | | | 10552–10836 |
| | | | | | 11269–11405 |
| | | | | | 13955–14021 |
| HLCAA05 | 2070 | 786434 | AL354726 | 12702 | 1–170 |
| HLCAA05 | 2070 | 786434 | AL354726 | 12703 | 1–101 |
| HLCAA05 | 2070 | 786434 | AC015928 | 12704 | 1–196 |
| HLDAB75 | 2071 | 1300744 | AC012313 | 12705 | 1–71 |
| | | | | | 144–180 |
| | | | | | 275–544 |
| | | | | | 916–1194 |
| | | | | | 1782–2081 |
| | | | | | 2814–3104 |
| | | | | | 5211–5764 |
| | | | | | 5831–6135 |
| | | | | | 6457–6682 |
| HLDAB75 | 2071 | 1300744 | AC012313 | 12706 | 1–421 |
| HLDAB75 | 2071 | 1300744 | AC012313 | 12707 | 1–348 |
| HLDQZ72 | 2086 | 1162029 | AP002813 | 12708 | 1–206 |
| HLDQZ72 | 2086 | 1162029 | AP002813 | 12709 | 1–571 |
| HLDQZ72 | 2086 | 1162029 | AC051652 | 12710 | 1–843 |
| HLDQZ72 | 2086 | 1162029 | AC024127 | 12711 | 1–1584 |
| | | | | | 1908–2030 |
| | | | | | 2354–2532 |
| | | | | | 5476–5757 |
| | | | | | 6412–6611 |
| | | | | | 10006–10346 |
| HLDQZ72 | 2086 | 1162029 | AC024127 | 12712 | 1–421 |
| HLHCF36 | 2092 | 1028781 | AC018888 | 12713 | 1–273 |
| | | | | | 421–775 |
| | | | | | 793–3747 |
| HLHCF36 | 2092 | 1028781 | AC018888 | 12714 | 1–212 |
| HLHCF36 | 2092 | 1028781 | AC018888 | 12715 | 1–296 |
| HLHDS79 | 2101 | 841017 | AC009108 | 12716 | 1–1379 |
| HLHDS79 | 2101 | 841017 | AC009108 | 12717 | 1–411 |
| HLHFE92 | 2109 | 1011466 | AL138795 | 12718 | 1–668 |
| | | | | | 1191–1384 |
| | | | | | 1534–1609 |
| | | | | | 1845–1969 |
| | | | | | 2108–2249 |
| | | | | | 2664–4913 |
| | | | | | 5446–5548 |
| | | | | | 5905–6028 |
| | | | | | 6126–6285 |
| | | | | | 6457–6523 |
| | | | | | 6707–6800 |
| | | | | | 7025–7167 |
| | | | | | 7687–7867 |
| | | | | | 8289–8419 |
| | | | | | 8548–8585 |
| | | | | | 11144–11470 |
| HLHFE92 | 2109 | 1011466 | AL365403 | 12719 | 1–668 |
| | | | | | 1191–1384 |
| | | | | | 1534–1609 |
| | | | | | 1845–1969 |
| | | | | | 2108–2249 |
| | | | | | 2664–4108 |
| HLHFE92 | 2109 | 1011466 | AL138795 | 12720 | 1–634 |
| HLHFE92 | 2109 | 1011466 | AL365403 | 12721 | 1–156 |
| HLLAX19 | 2121 | 852081 | Z93016 | 12722 | 1–4307 |
| HLLAX19 | 2121 | 852081 | Z93016 | 12723 | 1–552 |
| HLLAX19 | 2121 | 852081 | Z93016 | 12724 | 1–481 |
| HLMCA92 | 2125 | 1011488 | AC012020 | 12725 | 1–2610 |
| HLMCA92 | 2125 | 1011488 | AC012020 | 12726 | 1–123 |
| | | | | | 150–564 |
| | | | | | 1319–1415 |
| | | | | | 2434–2529 |
| | | | | | 3296–3397 |
| | | | | | 5269–5609 |
| | | | | | 6137–6628 |
| | | | | | 7039–7741 |
| | | | | | 8046–10046 |
| | | | | | 10261–12495 |
| | | | | | 12617–12842 |
| | | | | | 12946–16423 |
| HLMCA92 | 2125 | 1011488 | AC012020 | 12727 | 1–142 |
| HLQDY81 | 2152 | 1046266 | AC024468 | 12728 | 1–269 |
| | | | | | 2419–2560 |
| | | | | | 3305–3786 |
| | | | | | 4474–5582 |
| | | | | | 5736–6454 |
| | | | | | 6554–8813 |
| | | | | | 9717–9903 |
| HLQDY81 | 2152 | 1046266 | AC024468 | 12729 | 1–478 |
| HLQDY81 | 2152 | 1046266 | AC024468 | 12730 | 1–835 |
| HLSAD65 | 2154 | 490706 | AC018477 | 12731 | 1–316 |
| | | | | | 844–873 |
| | | | | | 888–1497 |
| | | | | | 1588–1655 |
| | | | | | 1750–1854 |
| | | | | | 1937–2044 |
| | | | | | 2120–2374 |
| | | | | | 2457–2577 |
| | | | | | 2668–2798 |
| | | | | | 3164–3280 |
| | | | | | 4332–4447 |
| | | | | | 4560–6222 |
| HLSAD65 | 2154 | 490706 | AC018477 | 12732 | 1–199 |
| HLSAF81 | 2155 | 704098 | AC021890 | 12733 | 1–2440 |
| HLSAF81 | 2155 | 704098 | AC068055 | 12734 | 1–149 |
| HLSAF81 | 2155 | 704098 | AC022232 | 12735 | 1–152 |
| HLSAF81 | 2155 | 704098 | AP001451 | 12736 | 1–96 |
| HLSAF81 | 2155 | 704098 | AC048342 | 12737 | 1–130 |
| HLSAF81 | 2155 | 704098 | AC009453 | 12738 | 1–143 |
| HLSAF81 | 2155 | 704098 | AC022231 | 12739 | 1–151 |
| HLSAF81 | 2155 | 704098 | AC010694 | 12740 | 1–202 |
| HLSAF81 | 2155 | 704098 | AC016327 | 12741 | 1–125 |
| HLSAF81 | 2155 | 704098 | AC034149 | 12742 | 1–28 |
| | | | | | 720–1025 |
| | | | | | 1159–1454 |
| | | | | | 1491–3985 |
| HLSAF81 | 2155 | 704098 | AC009524 | 12743 | 1–151 |
| HLSAF81 | 2155 | 704098 | AC021890 | 12744 | 1–73 |
| | | | | | 2266–2477 |
| | | | | | 4227–4351 |
| | | | | | 4366–4901 |
| HLSAF81 | 2155 | 704098 | AC021890 | 12745 | 1–293 |
| HLSAF81 | 2155 | 704098 | AC068055 | 12746 | 1–77 |
| HLSAF81 | 2155 | 704098 | AC048342 | 12747 | 1–118 |
| HLSAF81 | 2155 | 704098 | AC010694 | 12748 | 1–77 |
| HLSAF81 | 2155 | 704098 | AC034149 | 12749 | 1–74 |
| | | | | | 2263–2474 |
| | | | | | 4221–4348 |
| | | | | | 4363–4913 |
| | | | | | 6234–6958 |
| | | | | | 7777–8042 |
| | | | | | 8110–8368 |
| | | | | | 8427–8498 |
| | | | | | 8592–8727 |
| | | | | | 8925–8989 |
| | | | | | 9338–10583 |
| | | | | | 11024–12089 |
| | | | | | 14914–15126 |
| | | | | | 15783–15980 |
| HLSAF81 | 2155 | 704098 | AC034149 | 12750 | 1–184 |
| | | | | | 530–846 |
| | | | | | 902–1111 |
| | | | | | 3673–4635 |
| | | | | | 4983–5054 |
| | | | | | 5590–5660 |
| | | | | | 5815–5939 |
| | | | | | 6171–6228 |
| | | | | | 6399–6451 |
| | | | | | 6632–6776 |
| | | | | | 7911–8110 |
| | | | | | 8197–8267 |
| | | | | | 8346–8483 |
| | | | | | 8644–8888 |
| | | | | | 9154–9295 |
| | | | | | 10134–12493 |
| HLTDY51 | 2170 | 1028730 | AC011422 | 12751 | 1–3284 |

TABLE 1C-continued

| cDNA Clone ID | SEQ ID NO: X | CONTIG ID: | BAC ID: A | SEQ ID NO: B | EXON From-To |
|---|---|---|---|---|---|
| HLTDY51 | 2170 | 1028730 | AC008408 | 12752 | 1–3284 |
| HLTDY51 | 2170 | 1028730 | AC011340 | 12753 | 1–3284 |
| HLTDY51 | 2170 | 1028730 | AC011422 | 12754 | 1–413 |
| HLTDY51 | 2170 | 1028730 | AC011422 | 12755 | 1–683 |
| HLTDY51 | 2170 | 1028730 | AC008408 | 12756 | 1–413 |
| HLTDY51 | 2170 | 1028730 | AC008408 | 12757 | 1–683 |
| HLTDY51 | 2170 | 1028730 | AC011340 | 12758 | 1–413 |
| HLTHO84 | 2178 | 1034751 | AP001077 | 12759 | 1–628<br>2964–3018<br>3380–3771<br>3862–3960<br>4335–4807<br>4865–5522<br>7561–8061 |
| HLTIP27 | 2179 | 1135064 | AC005300 | 12760 | 1–2278<br>2517–2724<br>2937–3674<br>3951–4078<br>4161–4304<br>4655–4831<br>5992–6127<br>7339–7437<br>7494–7581<br>7636–7875<br>9038–9147<br>9728–10094<br>10642–10737<br>11318–12036<br>12382–12511<br>13422–13537<br>13793–14007<br>16086–16264<br>18577–18759<br>20954–21343<br>23790–24020<br>24295–24472<br>27684–27991<br>28937–29118<br>30054–30826 |
| HLTIP27 | 2179 | 1135064 | AC005300 | 12761 | 1–335 |
| HLWAZ70 | 2186 | 996196 | AC021267 | 12762 | 1–114<br>2214–2313<br>2729–2790<br>3122–3233<br>4932–5104<br>6623–6989<br>7351–12581 |
| HLWAZ70 | 2186 | 996196 | AC009836 | 12763 | 1–114<br>2214–2313<br>2729–2790<br>3122–3233<br>4932–5104<br>6623–6989<br>7351–12582 |
| HLWBG83 | 2188 | 965821 | AL139412 | 12764 | 1–294<br>302–516<br>974–1309<br>1640–5572 |
| HLWBG83 | 2188 | 965821 | AL139412 | 12765 | 1–239 |
| HLWBG83 | 2188 | 965821 | AL139412 | 12766 | 1–373 |
| HLWCP78 | 2194 | 941963 | AC008671 | 12767 | 1–4936 |
| HLYAA57 | 2197 | 519077 | AL356973 | 12768 | 1–1139 |
| HLYAA57 | 2197 | 519077 | AL356973 | 12769 | 1–340 |
| HLYAA57 | 2197 | 519077 | AL356973 | 12770 | 1–884 |
| HLYCK27 | 2209 | 1045495 | AP002812 | 12771 | 1–952 |
| HLYCK27 | 2209 | 1045495 | AP002377 | 12772 | 1–952 |
| HLYCK27 | 2209 | 1045495 | AP000580 | 12773 | 1–951 |
| HLYCK27 | 2209 | 1045495 | AP002812 | 12774 | 1–410 |
| HLYCK27 | 2209 | 1045495 | AP002377 | 12775 | 1–410 |
| HLYCK27 | 2209 | 1045495 | AP002377 | 12776 | 1–97<br>483–1269<br>1767–2329<br>2342–3134<br>3651–4014<br>4091–4335<br>4841–6077<br>6085–6144<br>6217–7713 |
| HLYCK27 | 2209 | 1045495 | AP000580 | 12777 | 1–280 |
| HLYDU43 | 2215 | 1001009 | AC009788 | 12778 | 1–165<br>3187–3576<br>4073–4179<br>4976–6059<br>6136–6779 |
| HMCHR48 | 2233 | 1036476 | AL031963 | 12779 | 1–131<br>229–540<br>572–796<br>1431–1525<br>3302–3592<br>3601–4560<br>4940–5045<br>6693–7543<br>8522–8693<br>10010–10483<br>11537–12146<br>12660–12968<br>13739–14119<br>14562–14988<br>15888–16175<br>16480–16722<br>17676–18073<br>20435–20754<br>21414–21522<br>24622–24893<br>30764–31105<br>31324–31719<br>32636–34242 |
| HMCHR48 | 2233 | 1036476 | AL031963 | 12780 | 1–2490 |
| HMCIJ07 | 2234 | 919889 | AC020978 | 12781 | 1–180<br>2776–2899<br>3916–4077<br>4296–4335<br>4436–4632<br>4895–5181<br>8153–8246<br>9547–9666<br>9907–10007<br>10370–10618<br>10788–11046<br>11926–13423<br>13465–13494<br>13764–15689 |
| HMCIJ07 | 2234 | 919889 | AC020978 | 12782 | 1–384 |
| HMELA16 | 2258 | 695740 | AC007240 | 12783 | 1–789<br>2087–2266 |
| HMELA16 | 2258 | 695740 | AC007240 | 12784 | 1–355 |
| HMHBN86 | 2261 | 1218297 | AC055752 | 12785 | 1–395<br>2457–2622<br>2683–2809 |
| HMHBN86 | 2261 | 1218297 | AL357119 | 12786 | 1–395<br>2457–2622<br>2683–2809 |
| HMHBN86 | 2261 | 1218297 | AC067998 | 12787 | 1–291<br>2353–2518<br>2579–2705 |
| HMIAV73 | 2267 | 1041834 | AC005032 | 12788 | 1–3203 |
| HMIAV73 | 2267 | 1041834 | AC005032 | 12789 | 1–3230 |
| HMJAK50 | 2272 | 493769 | AL357515 | 12790 | 1–729 |
| HMJAK63 | 2273 | 531912 | AL137179 | 12791 | 1–775 |
| HMJAK63 | 2273 | 531912 | AL137179 | 12792 | 1–921 |
| HMJAK63 | 2273 | 531912 | AL137179 | 12793 | 1–299 |
| HMKCV28 | 2280 | 1352221 | AC007459 | 12794 | 1–242 |
| HMKCV28 | 2280 | 1352221 | AC006512 | 12795 | 1–247<br>2812–2918<br>3488–3953<br>3964–4527<br>4683–5151<br>5330–9121<br>9884–10335<br>10748–10781<br>10960–11055<br>11323–12111 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 12127–12791 |
| | | | | | 12911–13262 |
| | | | | | 13266–13791 |
| | | | | | 14696–14866 |
| | | | | | 15107–15207 |
| | | | | | 16551–16955 |
| | | | | | 17174–17614 |
| | | | | | 18504–18749 |
| | | | | | 19392–19660 |
| | | | | | 19720–20075 |
| | | | | | 20785–21233 |
| | | | | | 21290–21733 |
| | | | | | 23618–23649 |
| | | | | | 23982–24188 |
| | | | | | 24481–24573 |
| | | | | | 24741–25003 |
| | | | | | 26591–26705 |
| | | | | | 26738–27249 |
| | | | | | 28479–28858 |
| | | | | | 29065–31669 |
| | | | | | 31926–32887 |
| | | | | | 33667–34293 |
| | | | | | 35229–35682 |
| | | | | | 38114–38771 |
| HMKCV28 | 2280 | 1352221 | AL357075 | 12796 | 1–1499 |
| HMKCV28 | 2280 | 1352221 | AC010073 | 12797 | 1–243 |
| HMKCV28 | 2280 | 1352221 | AC069217 | 12798 | 1–243 |
| HMKCV28 | 2280 | 1352221 | AC006512 | 12799 | 1–818 |
| | | | | | 963–1440 |
| | | | | | 1469–1958 |
| | | | | | 2220–3076 |
| | | | | | 3455–3663 |
| | | | | | 3931–4285 |
| | | | | | 4549–4632 |
| | | | | | 4696–5069 |
| | | | | | 5245–5337 |
| | | | | | 5461–5775 |
| HMKCV28 | 2280 | 1352221 | AC006512 | 12800 | 1–738 |
| HMKCY17 | 2282 | 498237 | AL158157 | 12801 | 1–330 |
| HMKCY17 | 2282 | 498237 | AC016003 | 12802 | 1–330 |
| HMKCY17 | 2282 | 498237 | AL353810 | 12803 | 1–330 |
| HMQBU44 | 2293 | 395771 | AC006544 | 12804 | 1–1379 |
| | | | | | 1472–1752 |
| | | | | | 1886–1978 |
| | | | | | 2100–2400 |
| | | | | | 2738–2819 |
| | | | | | 2944–3365 |
| | | | | | 3616–3677 |
| | | | | | 4455–5231 |
| | | | | | 6318–6460 |
| | | | | | 7193–7370 |
| | | | | | 8382–8463 |
| | | | | | 10572–10838 |
| | | | | | 14646–14746 |
| | | | | | 16405–16807 |
| | | | | | 19070–19407 |
| | | | | | 20767–21262 |
| | | | | | 21403–21555 |
| | | | | | 21796–21961 |
| | | | | | 22095–22260 |
| | | | | | 22778–23022 |
| | | | | | 23122–23235 |
| | | | | | 23315–23454 |
| | | | | | 23556–23669 |
| | | | | | 23699–25407 |
| | | | | | 25626–26703 |
| | | | | | 26727–26936 |
| | | | | | 27039–27606 |
| | | | | | 27627–27973 |
| | | | | | 28052–28194 |
| | | | | | 28265–29907 |
| | | | | | 29958–30904 |
| HMQBU44 | 2293 | 395771 | AC005041 | 12805 | 1–95 |
| | | | | | 175–314 |
| | | | | | 416–529 |
| | | | | | 559–2267 |
| | | | | | 2486–3563 |
| | | | | | 3587–3796 |
| | | | | | 3899–4466 |
| | | | | | 4487–4833 |
| | | | | | 4912–5054 |
| | | | | | 5125–6767 |
| | | | | | 6818–7764 |
| HMQBU44 | 2293 | 395771 | AC006544 | 12806 | 1–65 |
| | | | | | 453–712 |
| | | | | | 1003–1118 |
| HMQBU44 | 2293 | 395771 | AC006544 | 12807 | 1–380 |
| HMQBU44 | 2293 | 395771 | AC005041 | 12808 | 1–176 |
| HMQBU44 | 2293 | 395771 | AC005041 | 12809 | 1–65 |
| | | | | | 453–712 |
| | | | | | 1003–1118 |
| HMQDW19 | 2296 | 410546 | AC006512 | 12810 | 1–247 |
| | | | | | 2812–2918 |
| | | | | | 3488–3953 |
| | | | | | 3964–4527 |
| | | | | | 4683–5151 |
| | | | | | 5330–9121 |
| | | | | | 9884–10335 |
| | | | | | 10748–10781 |
| | | | | | 10960–11055 |
| | | | | | 11323–12111 |
| | | | | | 12127–12791 |
| | | | | | 12911–13262 |
| | | | | | 13266–13791 |
| | | | | | 14696–14866 |
| | | | | | 15107–15207 |
| | | | | | 16551–16955 |
| | | | | | 17174–17614 |
| | | | | | 18504–18749 |
| | | | | | 19392–19660 |
| | | | | | 19720–20075 |
| | | | | | 20785–21233 |
| | | | | | 21290–21733 |
| | | | | | 23618–23649 |
| | | | | | 23982–24188 |
| | | | | | 24481–24573 |
| | | | | | 24741–25003 |
| | | | | | 26591–26705 |
| | | | | | 26738–27249 |
| | | | | | 28479–28858 |
| | | | | | 29065–31669 |
| | | | | | 31926–32887 |
| | | | | | 33667–34293 |
| | | | | | 35229–35682 |
| | | | | | 38114–38771 |
| HMQDW19 | 2296 | 410546 | AC068594 | 12811 | 1–121 |
| HMQDW19 | 2296 | 410546 | AC022083 | 12812 | 1–144 |
| HMQDW19 | 2296 | 410546 | AC008439 | 12813 | 1–125 |
| HMQDW19 | 2296 | 410546 | AC034240 | 12814 | 1–141 |
| HMQDW19 | 2296 | 410546 | AC024491 | 12815 | 1–130 |
| HMQDW19 | 2296 | 410546 | AC022032 | 12816 | 1–146 |
| HMQDW19 | 2296 | 410546 | AC022813 | 12817 | 1–161 |
| HMQDW19 | 2296 | 410546 | AP002357 | 12818 | 1–170 |
| HMQDW19 | 2296 | 410546 | AC068243 | 12819 | 1–124 |
| HMQDW19 | 2296 | 410546 | AC009502 | 12820 | 1–122 |
| HMQDW19 | 2296 | 410546 | AC027373 | 12821 | 1–125 |
| HMQDW19 | 2296 | 410546 | AC009562 | 12822 | 1–95 |
| HMQDW19 | 2296 | 410546 | AC015667 | 12823 | 1–121 |
| HMQDW19 | 2296 | 410546 | AC068025 | 12824 | 1–127 |
| HMQDW19 | 2296 | 410546 | AC022440 | 12825 | 1–122 |
| HMQDW19 | 2296 | 410546 | AC006512 | 12826 | 1–818 |
| | | | | | 963–1440 |
| | | | | | 1469–1958 |
| | | | | | 2220–3076 |
| | | | | | 3455–3663 |
| | | | | | 3931–4285 |
| | | | | | 4549–4632 |
| | | | | | 4696–5069 |
| | | | | | 5245–5337 |
| | | | | | 5461–5775 |
| HMQDW19 | 2296 | 410546 | AC006512 | 12827 | 1–738 |
| HMQDW19 | 2296 | 410546 | AC022083 | 12828 | 1–131 |

TABLE 1C-continued

| cDNA Clone ID | SEQ ID NO: X | CONTIG ID: | BAC ID: A | SEQ ID NO: B | EXON From-To |
|---|---|---|---|---|---|
| HMRAD54 | 2297 | 1162421 | AC023786 | 12829 | 1–1165 |
|  |  |  |  |  | 1586–1624 |
|  |  |  |  |  | 1808–2761 |
|  |  |  |  |  | 3231–3329 |
|  |  |  |  |  | 3534–7009 |
|  |  |  |  |  | 7036–8261 |
| HMRAD54 | 2297 | 1162421 | AC023786 | 12830 | 1–280 |
| HMRAD54 | 2297 | 1162421 | AC023786 | 12831 | 1–802 |
| HMSFK67 | 2306 | 907268 | AC078898 | 12832 | 1–640 |
| HMSFK67 | 2306 | 907268 | AC074196 | 12833 | 1–606 |
| HMSFK67 | 2306 | 907268 | AC077693 | 12834 | 1–628 |
| HMSFK67 | 2306 | 907268 | AC027037 | 12835 | 1–640 |
| HMSFK67 | 2306 | 907268 | AC026757 | 12836 | 1–513 |
| HMSFK67 | 2306 | 907268 | AC027036 | 12837 | 1–612 |
| HMSFK67 | 2306 | 907268 | AC074108 | 12838 | 1–462 |
| HMSFK67 | 2306 | 907268 | AC074226 | 12839 | 1–640 |
| HMSFK67 | 2306 | 907268 | AC073166 | 12840 | 1–640 |
| HMSFK67 | 2306 | 907268 | AC068667 | 12841 | 1–654 |
| HMSFK67 | 2306 | 907268 | AC024594 | 12842 | 1–414 |
| HMSFK67 | 2306 | 907268 | AC024261 | 12843 | 1–647 |
| HMSFK67 | 2306 | 907268 | AC078893 | 12844 | 1–640 |
| HMSFK67 | 2306 | 907268 | AC073555 | 12845 | 1–640 |
| HMSFK67 | 2306 | 907268 | AC069474 | 12846 | 1–571 |
| HMSFK67 | 2306 | 907268 | AC068924 | 12847 | 1–640 |
| HMSFK67 | 2306 | 907268 | AC066689 | 12848 | 1–639 |
| HMSFK67 | 2306 | 907268 | AC035249 | 12849 | 1–397 |
| HMSFK67 | 2306 | 907268 | AC034258 | 12850 | 1–648 |
| HMSFK67 | 2306 | 907268 | AC027135 | 12851 | 1–434 |
| HMSFK67 | 2306 | 907268 | AC027035 | 12852 | 1–624 |
| HMSFK67 | 2306 | 907268 | AC027034 | 12853 | 1–509 |
| HMSFK67 | 2306 | 907268 | AC026815 | 12854 | 1–654 |
| HMSFK67 | 2306 | 907268 | AC025781 | 12855 | 1–546 |
| HMSFK67 | 2306 | 907268 | AC078894 | 12856 | 1–654 |
| HMSJO79 | 2316 | 429250 | AL031718 | 12857 | 1–3145 |
|  |  |  |  |  | 3748–5002 |
|  |  |  |  |  | 5327–5744 |
|  |  |  |  |  | 5796–5852 |
| HMSJO79 | 2316 | 429250 | AC012180 | 12858 | 1–567 |
|  |  |  |  |  | 626–2535 |
|  |  |  |  |  | 2968–4391 |
|  |  |  |  |  | 4716–5133 |
|  |  |  |  |  | 5185–5241 |
| HMSJO79 | 2316 | 429250 | AL031718 | 12859 | 1–297 |
| HMSJO79 | 2316 | 429250 | AC012180 | 12860 | 1–296 |
| HMSKC10 | 2320 | 1133905 | AC074366 | 12861 | 1–2725 |
| HMSKC10 | 2320 | 1133905 | AC011152 | 12862 | 1–2726 |
| HMSKC10 | 2320 | 1133905 | AC074366 | 12863 | 1–358 |
| HMSKC10 | 2320 | 1133905 | AC011152 | 12864 | 1–358 |
| HMSKS35 | 2324 | 705097 | AL023096 | 12865 | 1–1248 |
| HMSKS35 | 2324 | 705097 | AL023096 | 12866 | 1–883 |
| HMSOC30 | 2327 | 1033846 | AC006146 | 12867 | 1–137 |
|  |  |  |  |  | 891–1391 |
|  |  |  |  |  | 1933–2259 |
|  |  |  |  |  | 3333–3483 |
|  |  |  |  |  | 3779–5994 |
|  |  |  |  |  | 6034–6744 |
|  |  |  |  |  | 6881–7068 |
|  |  |  |  |  | 7238–7372 |
|  |  |  |  |  | 7457–8908 |
|  |  |  |  |  | 8950–9403 |
|  |  |  |  |  | 10275–10563 |
| HMSOC30 | 2327 | 1033846 | AC006146 | 12868 | 1–2315 |
|  |  |  |  |  | 2869–3270 |
| HMTAC69 | 2329 | 517994 | AC016359 | 12869 | 1–1036 |
| HMTAC69 | 2329 | 517994 | AC022673 | 12870 | 1–1036 |
| HMVCQ82 | 2346 | 1003027 | AC016927 | 12871 | 1–93 |
|  |  |  |  |  | 436–573 |
|  |  |  |  |  | 1504–1585 |
|  |  |  |  |  | 1922–1971 |
|  |  |  |  |  | 2635–2726 |
|  |  |  |  |  | 3541–3731 |
|  |  |  |  |  | 6137–6496 |
|  |  |  |  |  | 6517–6700 |
|  |  |  |  |  | 7141–7604 |
|  |  |  |  |  | 7621–8670 |
|  |  |  |  |  | 8705–9096 |
|  |  |  |  |  | 9766–10170 |
|  |  |  |  |  | 10425–10501 |
|  |  |  |  |  | 10987–11087 |
|  |  |  |  |  | 11341–11941 |
|  |  |  |  |  | 12244–15601 |
|  |  |  |  |  | 15897–16018 |
| HMVCQ82 | 2346 | 1003027 | AC024903 | 12872 | 1–244 |
|  |  |  |  |  | 278–784 |
|  |  |  |  |  | 2960–3209 |
|  |  |  |  |  | 6353–6483 |
|  |  |  |  |  | 6826–6963 |
|  |  |  |  |  | 7892–7976 |
|  |  |  |  |  | 8310–8359 |
|  |  |  |  |  | 9023–9114 |
|  |  |  |  |  | 9928–10118 |
|  |  |  |  |  | 12523–12882 |
|  |  |  |  |  | 12903–13086 |
|  |  |  |  |  | 13527–13990 |
|  |  |  |  |  | 14007–15056 |
|  |  |  |  |  | 15091–15482 |
|  |  |  |  |  | 16152–16556 |
|  |  |  |  |  | 16811–16887 |
|  |  |  |  |  | 17373–17473 |
|  |  |  |  |  | 17727–18327 |
|  |  |  |  |  | 18630–21983 |
|  |  |  |  |  | 22279–22400 |
| HMVCQ82 | 2346 | 1003027 | AC016927 | 12873 | 1–442 |
| HMVCQ82 | 2346 | 1003027 | AC024903 | 12874 | 1–442 |
| HMVDL30 | 2349 | 1007828 | AL354681 | 12875 | 1–677 |
|  |  |  |  |  | 1534–3323 |
| HMVDL30 | 2349 | 1007828 | AL354681 | 12876 | 1–383 |
| HMVDP35 | 2350 | 1035381 | AP000666 | 12877 | 1–2105 |
| HMVDP35 | 2350 | 1035381 | AC009544 | 12878 | 1–2104 |
| HMVDP35 | 2350 | 1035381 | AP001163 | 12879 | 1–2104 |
| HMVDP35 | 2350 | 1035381 | AC009544 | 12880 | 1–668 |
| HMWEJ52 | 2358 | 1034153 | AC013279 | 12881 | 1–3353 |
|  |  |  |  |  | 5334–5764 |
|  |  |  |  |  | 5899–7420 |
|  |  |  |  |  | 7479–8058 |
|  |  |  |  |  | 8404–9564 |
|  |  |  |  |  | 9756–10316 |
| HMWEJ52 | 2358 | 1034153 | AC013279 | 12882 | 1–1352 |
| HNALC70 | 2377 | 511142 | AC027040 | 12883 | 1–863 |
|  |  |  |  |  | 986–1184 |
|  |  |  |  |  | 1717–2018 |
|  |  |  |  |  | 2772–2989 |
|  |  |  |  |  | 3885–4494 |
|  |  |  |  |  | 4593–4747 |
|  |  |  |  |  | 4755–4798 |
|  |  |  |  |  | 4854–5327 |
|  |  |  |  |  | 5398–5750 |
|  |  |  |  |  | 5784–7177 |
|  |  |  |  |  | 7358–7446 |
|  |  |  |  |  | 7656–9438 |
|  |  |  |  |  | 9699–10020 |
| HNALC70 | 2377 | 511142 | AC027040 | 12884 | 1–469 |
| HNALC70 | 2377 | 511142 | AC027040 | 12885 | 1–307 |
|  |  |  |  |  | 800–1077 |
|  |  |  |  |  | 1122–1517 |
|  |  |  |  |  | 2166–2193 |
| HNFFC27 | 2400 | 487547 | AC011962 | 12886 | 1–102 |
| HNFFC27 | 2400 | 487547 | AC021384 | 12887 | 1–93 |
| HNFFC27 | 2400 | 487547 | AC012110 | 12888 | 1–98 |
| HNFFC27 | 2400 | 487547 | AC068626 | 12889 | 1–101 |
| HNFFC27 | 2400 | 487547 | AC009097 | 12890 | 1–101 |
| HNFFC27 | 2400 | 487547 | AC008470 | 12891 | 1–129 |
| HNFFC27 | 2400 | 487547 | AC027095 | 12892 | 1–93 |
| HNFFC27 | 2400 | 487547 | AC012406 | 12893 | 1–545 |
| HNFFC27 | 2400 | 487547 | AC012110 | 12894 | 1–160 |
|  |  |  |  |  | 3021–4802 |
| HNFFC27 | 2400 | 487547 | AC012406 | 12895 | 1–400 |
| HNFFC27 | 2400 | 487547 | AC012406 | 12896 | 1–546 |
| HNFFD47 | 2402 | 1042312 | AC006512 | 12897 | 1–247 |
|  |  |  |  |  | 2812–2918 |
|  |  |  |  |  | 3488–3953 |
|  |  |  |  |  | 3964–4527 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 4683–5151 |
| | | | | | 5330–9121 |
| | | | | | 9884–10335 |
| | | | | | 10748–10781 |
| | | | | | 10960–11055 |
| | | | | | 11323–12111 |
| | | | | | 12127–12791 |
| | | | | | 12911–13262 |
| | | | | | 13266–13791 |
| | | | | | 14696–14866 |
| | | | | | 15107–15207 |
| | | | | | 16551–16955 |
| | | | | | 17174–17614 |
| | | | | | 18504–18749 |
| | | | | | 19392–19660 |
| | | | | | 19720–20075 |
| | | | | | 20785–21233 |
| | | | | | 21290–21733 |
| | | | | | 23618–23649 |
| | | | | | 23982–24188 |
| | | | | | 24481–24573 |
| | | | | | 24741–25003 |
| | | | | | 26591–26705 |
| | | | | | 26738–27249 |
| | | | | | 28479–28858 |
| | | | | | 29065–31669 |
| | | | | | 31926–32887 |
| | | | | | 33667–34293 |
| | | | | | 35229–35682 |
| | | | | | 38114–38771 |
| HNFFD47 | 2402 | 1042312 | AL355998 | 12898 | 1–1782 |
| HNFFD47 | 2402 | 1042312 | AC023251 | 12899 | 1–1782 |
| HNFFD47 | 2402 | 1042312 | AL357835 | 12900 | 1–1782 |
| HNFFD47 | 2402 | 1042312 | AC006512 | 12901 | 1–818 |
| | | | | | 963–1440 |
| | | | | | 1469–1958 |
| | | | | | 2220–3076 |
| | | | | | 3455–3663 |
| | | | | | 3931–4285 |
| | | | | | 4549–4632 |
| | | | | | 4696–5069 |
| | | | | | 5245–5337 |
| | | | | | 5461–5775 |
| HNFFD47 | 2402 | 1042312 | AC006512 | 12902 | 1–738 |
| HNFFD47 | 2402 | 1042312 | AL355998 | 12903 | 1–410 |
| HNFFD47 | 2402 | 1042312 | AC023251 | 12904 | 1–410 |
| HNFFD47 | 2402 | 1042312 | AC023251 | 12905 | 1–513 |
| HNFFD47 | 2402 | 1042312 | AL357835 | 12906 | 1–513 |
| HNFFD47 | 2402 | 1042312 | AL357835 | 12907 | 1–410 |
| HNFHY51 | 2411 | 1032667 | AL356107 | 12908 | 1–9147 |
| HNFHY51 | 2411 | 1032667 | AL356107 | 12909 | 1–332 |
| HNGAU09 | 2426 | 395801 | AL365198 | 12910 | 1–621 |
| HNGAV54 | 2428 | 1034812 | AC078898 | 12911 | 1–640 |
| HNGAV54 | 2428 | 1034812 | AC074196 | 12912 | 1–606 |
| HNGAV54 | 2428 | 1034812 | AC077693 | 12913 | 1–628 |
| HNGAV54 | 2428 | 1034812 | AP002376 | 12914 | 1–1329 |
| HNGAV54 | 2428 | 1034812 | AC027037 | 12915 | 1–640 |
| HNGAV54 | 2428 | 1034812 | AC026757 | 12916 | 1–513 |
| HNGAV54 | 2428 | 1034812 | AC027036 | 12917 | 1–612 |
| HNGAV54 | 2428 | 1034812 | AC074108 | 12918 | 1–462 |
| HNGAV54 | 2428 | 1034812 | AC074226 | 12919 | 1–640 |
| HNGAV54 | 2428 | 1034812 | AC073166 | 12920 | 1–640 |
| HNGAV54 | 2428 | 1034812 | AC068667 | 12921 | 1–654 |
| HNGAV54 | 2428 | 1034812 | AC024261 | 12922 | 1–647 |
| HNGAV54 | 2428 | 1034812 | AP000943 | 12923 | 1–1229 |
| HNGAV54 | 2428 | 1034812 | AC078893 | 12924 | 1–640 |
| HNGAV54 | 2428 | 1034812 | AC073555 | 12925 | 1–640 |
| HNGAV54 | 2428 | 1034812 | AC069474 | 12926 | 1–571 |
| HNGAV54 | 2428 | 1034812 | AC068924 | 12927 | 1–640 |
| HNGAV54 | 2428 | 1034812 | AC066689 | 12928 | 1–639 |
| HNGAV54 | 2428 | 1034812 | AC034258 | 12929 | 1–648 |
| HNGAV54 | 2428 | 1034812 | AC027135 | 12930 | 1–434 |
| HNGAV54 | 2428 | 1034812 | AC027035 | 12931 | 1–624 |
| HNGAV54 | 2428 | 1034812 | AC027034 | 12932 | 1–509 |
| HNGAV54 | 2428 | 1034812 | AC026815 | 12933 | 1–654 |
| HNGAV54 | 2428 | 1034812 | AC025781 | 12934 | 1–546 |
| HNGAV54 | 2428 | 1034812 | AC078894 | 12935 | 1–654 |
| HNGBQ56 | 2436 | 878979 | AC008123 | 12936 | 1–3904 |
| HNGBQ56 | 2436 | 878979 | AC008123 | 12937 | 1–629 |
| | | | | | 734–1972 |
| HNGEY29 | 2464 | 1190491 | AC074189 | 12938 | 1–836 |
| HNGEY29 | 2464 | 1190491 | AC074189 | 12939 | 1–390 |
| HNGFB76 | 2467 | 1036565 | AC006512 | 12940 | 1–247 |
| | | | | | 2812–2918 |
| | | | | | 3488–3953 |
| | | | | | 3964–4527 |
| | | | | | 4683–5151 |
| | | | | | 5330–9121 |
| | | | | | 9884–10335 |
| | | | | | 10748–10781 |
| | | | | | 10960–11055 |
| | | | | | 11323–12111 |
| | | | | | 12127–12791 |
| | | | | | 12911–13262 |
| | | | | | 13266–13791 |
| | | | | | 14696–14866 |
| | | | | | 15107–15207 |
| | | | | | 16551–16955 |
| | | | | | 17174–17614 |
| | | | | | 18504–18749 |
| | | | | | 19392–19660 |
| | | | | | 19720–20075 |
| | | | | | 20785–21233 |
| | | | | | 21290–21733 |
| | | | | | 23618–23649 |
| | | | | | 23982–24188 |
| | | | | | 24481–24573 |
| | | | | | 24741–25003 |
| | | | | | 26591–26705 |
| | | | | | 26738–27249 |
| | | | | | 28479–28858 |
| | | | | | 29065–31669 |
| | | | | | 31926–32887 |
| | | | | | 33667–34293 |
| | | | | | 35229–35682 |
| | | | | | 38114–38771 |
| HNGFB76 | 2467 | 1036565 | AC008690 | 12941 | 1–164 |
| HNGFB76 | 2467 | 1036565 | AC011168 | 12942 | 1–139 |
| HNGFB76 | 2467 | 1036565 | AC023073 | 12943 | 1–924 |
| HNGFB76 | 2467 | 1036565 | AC006512 | 12944 | 1–818 |
| | | | | | 963–1440 |
| | | | | | 1469–1958 |
| | | | | | 2220–3076 |
| | | | | | 3455–3663 |
| | | | | | 3931–4285 |
| | | | | | 4549–4632 |
| | | | | | 4696–5069 |
| | | | | | 5245–5337 |
| | | | | | 5461–5775 |
| HNGFB76 | 2467 | 1036565 | AC006512 | 12945 | 1–738 |
| HNGFB76 | 2467 | 1036565 | AC023073 | 12946 | 1–84 |
| HNGGK54 | 2478 | 919893 | AC021223 | 12947 | 1–1055 |
| HNGGK54 | 2478 | 919893 | AL358393 | 12948 | 1–1055 |
| HNGIC24 | 2485 | 493841 | AL050343 | 12949 | 1–818 |
| | | | | | 1041–1182 |
| | | | | | 1882–2064 |
| | | | | | 2647–2724 |
| | | | | | 2783–3120 |
| | | | | | 3841–4448 |
| | | | | | 4506–4617 |
| | | | | | 5889–5973 |
| | | | | | 7196–8433 |
| | | | | | 8435–9806 |
| | | | | | 9963–10860 |
| | | | | | 11348–11767 |
| | | | | | 12090–12798 |
| | | | | | 13661–14422 |
| | | | | | 15806–15928 |
| | | | | | 16351–16423 |
| HNGIC24 | 2485 | 493841 | AL359372 | 12950 | 1–709 |
| HNGIC24 | 2485 | 493841 | AL050343 | 12951 | 1–64 |
| | | | | | 1741–2928 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 3317–3441 |
| | | | | | 3507–4097 |
| | | | | | 6030–6141 |
| | | | | | 7728–7852 |
| | | | | | 8703–8819 |
| | | | | | 8823–9257 |
| | | | | | 11215–11339 |
| | | | | | 12571–12622 |
| | | | | | 14166–14321 |
| | | | | | 16327–16807 |
| | | | | | 17449–17583 |
| | | | | | 19073–20364 |
| | | | | | 21091–21197 |
| | | | | | 21264–21377 |
| | | | | | 21589–23188 |
| | | | | | 23245–23316 |
| | | | | | 23522–23660 |
| | | | | | 24107–24442 |
| | | | | | 25664–26124 |
| | | | | | 26470–26554 |
| | | | | | 26975–27324 |
| | | | | | 27479–27602 |
| | | | | | 27665–29449 |
| HNGIC24 | 2485 | 493841 | AL050343 | 12952 | 1–510 |
| HNGIC24 | 2485 | 493841 | AL359372 | 12953 | 1–608 |
| | | | | | 666–777 |
| | | | | | 2049–2133 |
| | | | | | 3356–4593 |
| | | | | | 4595–5966 |
| | | | | | 6123–7020 |
| | | | | | 7508–7927 |
| HNGIN16 | 2489 | 514827 | AC026285 | 12954 | 1–1458 |
| | | | | | 1729–1836 |
| HNGIN16 | 2489 | 514827 | AC023920 | 12955 | 1–1459 |
| | | | | | 1730–1837 |
| HNGIN16 | 2489 | 514827 | AC026285 | 12956 | 1–395 |
| | | | | | 591–645 |
| HNGIN16 | 2489 | 514827 | AC026285 | 12957 | 1–414 |
| | | | | | 440–1918 |
| HNGIN16 | 2489 | 514827 | AC023920 | 12958 | 1–416 |
| | | | | | 442–1920 |
| HNGIN16 | 2489 | 514827 | AC023920 | 12959 | 1–395 |
| | | | | | 591–645 |
| HNGIN60 | 2490 | 695769 | AF176678 | 12960 | 1–1435 |
| HNGIN60 | 2490 | 695769 | AF235094 | 12961 | 1–1435 |
| HNGIN60 | 2490 | 695769 | AF176678 | 12962 | 1–427 |
| HNGIQ57 | 2493 | 1045662 | AC005212 | 12963 | 1–51 |
| | | | | | 830–1231 |
| | | | | | 1706–1768 |
| | | | | | 1883–2170 |
| | | | | | 2958–3556 |
| | | | | | 3951–4233 |
| | | | | | 4846–5099 |
| HNGIQ57 | 2493 | 1045662 | AC024088 | 12964 | 1–314 |
| | | | | | 1851–1901 |
| | | | | | 2313–2471 |
| | | | | | 2678–3079 |
| | | | | | 3731–4021 |
| | | | | | 4806–5404 |
| | | | | | 5798–6112 |
| HNGIQ57 | 2493 | 1045662 | AC005212 | 12965 | 1–300 |
| HNGIQ57 | 2493 | 1045662 | AC005212 | 12966 | 1–298 |
| HNGIT16 | 2495 | 331288 | AC023879 | 12967 | 1–198 |
| HNGIT16 | 2495 | 331288 | AL138801 | 12968 | 1–198 |
| HNGIT16 | 2495 | 331288 | AC022661 | 12969 | 1–198 |
| HNGMJ91 | 2518 | 889182 | AP002377 | 12970 | 1–1962 |
| HNGMJ91 | 2518 | 889182 | AP002812 | 12971 | 1–1962 |
| HNGMJ91 | 2518 | 889182 | AC018610 | 12972 | 1–1962 |
| HNGNB69 | 2519 | 833405 | AC006460 | 12973 | 1–1666 |
| HNGNB69 | 2519 | 833405 | AC006460 | 12974 | 1–1255 |
| HNGNB69 | 2519 | 833405 | AC006460 | 12975 | 1–234 |
| | | | | | 1449–1767 |
| HNGNN78 | 2521 | 919894 | AC018552 | 12976 | 1–96 |
| | | | | | 289–617 |
| | | | | | 1256–1542 |
| | | | | | 2572–4992 |
| HNGNN78 | 2521 | 919894 | AC018552 | 12977 | 1–103 |
| | | | | | 242–356 |
| | | | | | 479–1465 |
| | | | | | 3671–3861 |
| HNGNN78 | 2521 | 919894 | AC018552 | 12978 | 1–148 |
| HNGNS74 | 2522 | 1035618 | AC021142 | 12979 | 1–604 |
| HNGNS74 | 2522 | 1035618 | AC021142 | 12980 | 1–108 |
| HNGOQ44 | 2525 | 1045353 | AC022045 | 12981 | 1–194 |
| | | | | | 1248–1772 |
| | | | | | 2804–2904 |
| | | | | | 3164–3399 |
| HNGOQ44 | 2525 | 1045353 | AP001972 | 12982 | 1–194 |
| | | | | | 1248–1772 |
| | | | | | 2804–2904 |
| | | | | | 3164–3399 |
| HNGOQ44 | 2525 | 1045353 | AC022045 | 12983 | 1–173 |
| HNGOQ44 | 2525 | 1045353 | AP001972 | 12984 | 1–173 |
| HNGPM78 | 2527 | 1008207 | AC004660 | 12985 | 1–1811 |
| HNGPM78 | 2527 | 1008207 | AC004660 | 12986 | 1–446 |
| HNHBI47 | 2534 | 839269 | AC019052 | 12987 | 1–705 |
| HNHBI47 | 2534 | 839269 | AC019052 | 12988 | 1–159 |
| HNHBM26 | 2537 | 490623 | AC074219 | 12989 | 1–565 |
| HNHBM26 | 2537 | 490623 | AC034242 | 12990 | 1–1074 |
| HNHBM26 | 2537 | 490623 | AC074219 | 12991 | 1–393 |
| HNHBM80 | 2538 | 709678 | AC015911 | 12992 | 1–1480 |
| HNHEA64 | 2549 | 634831 | AC022463 | 12993 | 1–302 |
| HNHEA64 | 2549 | 634831 | AC022463 | 12994 | 1–219 |
| HNHEU34 | 2567 | 1352238 | AC004876 | 12995 | 1–1077 |
| | | | | | 1101–1431 |
| | | | | | 2137–2706 |
| HNHEU34 | 2567 | 1352238 | AC004876 | 12996 | 1–364 |
| HNHEU34 | 2567 | 1352238 | AC004876 | 12997 | 1–537 |
| HNHGD15 | 2589 | 516697 | AC005625 | 12998 | 1–772 |
| HNHGD15 | 2589 | 516697 | AC005625 | 12999 | 1–83 |
| | | | | | 260–628 |
| HNHGD15 | 2589 | 516697 | AC005625 | 13000 | 1–778 |
| | | | | | 2027–2712 |
| | | | | | 3036–3356 |
| HNHGN74 | 2592 | 765603 | AC026418 | 13001 | 1–1165 |
| HNHGN74 | 2592 | 765603 | AC011952 | 13002 | 1–1166 |
| HNHHD42 | 2596 | 371569 | AL136221 | 13003 | 1–347 |
| HNHHD42 | 2596 | 371569 | AC007721 | 13004 | 1–347 |
| HNHKS18 | 2600 | 892316 | AC018512 | 13005 | 1–776 |
| HNHKS18 | 2600 | 892316 | AC022305 | 13006 | 1–878 |
| HNHKS18 | 2600 | 892316 | AC002518 | 13007 | 1–150 |
| HNHKS18 | 2600 | 892316 | AC016135 | 13008 | 1–845 |
| HNHNT13 | 2608 | 1009532 | AC068958 | 13009 | 1–1493 |
| HNHNT13 | 2608 | 1009532 | AC068958 | 13010 | 1–413 |
| HNHNT13 | 2608 | 1009532 | AC068958 | 13011 | 1–326 |
| | | | | | 1651–2260 |
| | | | | | 2582–2869 |
| | | | | | 4751–4854 |
| | | | | | 8201–8626 |
| | | | | | 10712–11162 |
| | | | | | 11466–11744 |
| | | | | | 12015–12332 |
| | | | | | 12784–13140 |
| | | | | | 13172–13511 |
| | | | | | 15974–16243 |
| | | | | | 16391–17850 |
| | | | | | 17986–18274 |
| HNHOD23 | 2610 | 1091787 | AP000934 | 13012 | 1–293 |
| | | | | | 329–806 |
| | | | | | 2280–2450 |
| | | | | | 2982–3129 |
| | | | | | 4657–4771 |
| | | | | | 5514–5680 |
| | | | | | 7163–7550 |
| | | | | | 8570–9406 |
| | | | | | 9425–10143 |
| HNHOD23 | 2610 | 1091787 | AP000934 | 13013 | 1–288 |
| HNKEL47 | 2618 | 1093341 | AL121901 | 13014 | 1–1016 |
| | | | | | 1191–1254 |
| | | | | | 1836–1926 |
| | | | | | 2925–3078 |
| | | | | | 3399–3507 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 4052–4971 |
| | | | | | 5096–5256 |
| | | | | | 5439–5617 |
| | | | | | 7262–7307 |
| HNTBN41 | 2627 | 1144026 | AC010336 | 13015 | 1–84 |
| | | | | | 910–1060 |
| | | | | | 1138–1298 |
| | | | | | 1578–1663 |
| | | | | | 2216–2309 |
| | | | | | 2396–2759 |
| | | | | | 2794–4844 |
| | | | | | 5057–5274 |
| | | | | | 5959–6108 |
| | | | | | 6454–6644 |
| | | | | | 6982–7071 |
| | | | | | 7375–7492 |
| | | | | | 7676–8431 |
| HNTBN41 | 2627 | 1144026 | AC024700 | 13016 | 1–128 |
| | | | | | 439–758 |
| | | | | | 2536–2632 |
| | | | | | 4631–4926 |
| | | | | | 5533–5729 |
| | | | | | 8297–8400 |
| | | | | | 8586–8666 |
| | | | | | 9490–9645 |
| | | | | | 9723–9883 |
| | | | | | 10163–10250 |
| | | | | | 10800–10894 |
| | | | | | 10979–11342 |
| | | | | | 11377–13411 |
| | | | | | 13635–13780 |
| | | | | | 14537–14686 |
| | | | | | 15033–15223 |
| | | | | | 15560–15655 |
| | | | | | 15951–16068 |
| | | | | | 16252–17003 |
| HNTBN41 | 2627 | 1144026 | AC010336 | 13017 | 1–104 |
| HNTBN41 | 2627 | 1144026 | AC024700 | 13018 | 1–767 |
| HNTCH90 | 2629 | 893684 | AC010226 | 13019 | 1–2859 |
| | | | | | 3740–4169 |
| | | | | | 4761–5916 |
| | | | | | 5935–6961 |
| HNTCH90 | 2629 | 893684 | AC008628 | 13020 | 1–2857 |
| | | | | | 3756–4185 |
| | | | | | 4777–6941 |
| HNTCH90 | 2629 | 893684 | AC022114 | 13021 | 1–2860 |
| HNTCH90 | 2629 | 893684 | AC010226 | 13022 | 1–386 |
| HNTCH90 | 2629 | 893684 | AC010226 | 13023 | 1–539 |
| HNTCH90 | 2629 | 893684 | AC008628 | 13024 | 1–539 |
| HNTCH90 | 2629 | 893684 | AC008628 | 13025 | 1–402 |
| HNTCH90 | 2629 | 893684 | AC022114 | 13026 | 1–365 |
| HNTDE84 | 2630 | 1032589 | AC073842 | 13027 | 1–325 |
| | | | | | 994–1147 |
| | | | | | 2430–3903 |
| HNTDE84 | 2630 | 1032589 | AC073842 | 13028 | 1–101 |
| HNTDE84 | 2630 | 1032589 | AC073842 | 13029 | 1–289 |
| | | | | | 629–1336 |
| | | | | | 2042–2127 |
| | | | | | 2301–2915 |
| | | | | | 3729–4698 |
| | | | | | 5045–5091 |
| HNTDL21 | 2631 | 1184440 | AC006559 | 13030 | 1–198 |
| | | | | | 606–685 |
| | | | | | 852–911 |
| | | | | | 1081–1623 |
| | | | | | 1671–1870 |
| | | | | | 2719–2803 |
| | | | | | 4854–6680 |
| | | | | | 8699–8830 |
| | | | | | 9908–10559 |
| | | | | | 10765–10897 |
| | | | | | 12977–13047 |
| | | | | | 14129–14290 |
| | | | | | 16213–16313 |
| | | | | | 20066–20119 |
| HNTDL21 | 2631 | 1184440 | AC022072 | 13031 | 1–198 |
| | | | | | 606–685 |
| | | | | | 852–911 |
| | | | | | 1081–1621 |
| | | | | | 1669–1868 |
| | | | | | 2719–2803 |
| | | | | | 4854–6680 |
| | | | | | 8699–8830 |
| | | | | | 9908–10559 |
| | | | | | 10765–10897 |
| | | | | | 12977–13047 |
| | | | | | 14129–14290 |
| | | | | | 16213–16313 |
| | | | | | 20066–20119 |
| HNTDL21 | 2631 | 1184440 | AC006559 | 13032 | 1–538 |
| HNTDL21 | 2631 | 1184440 | AC022072 | 13033 | 1–538 |
| HNTNB49 | 2639 | 1018296 | AC023818 | 13034 | 1–1134 |
| | | | | | 4235–6638 |
| HNTNB49 | 2639 | 1018296 | AC023818 | 13035 | 1–84 |
| HNTRS57 | 2643 | 973995 | AC022505 | 13036 | 1–786 |
| | | | | | 2100–2169 |
| | | | | | 2245–2402 |
| | | | | | 2660–3199 |
| | | | | | 3426–3720 |
| | | | | | 3767–4149 |
| | | | | | 4174–4305 |
| | | | | | 4439–4628 |
| | | | | | 4690–5455 |
| HNTRS57 | 2643 | 973995 | AC022505 | 13037 | 1–427 |
| HNTRW30 | 2644 | 1193071 | AL354887 | 13038 | 1–157 |
| | | | | | 268–361 |
| | | | | | 1810–2008 |
| | | | | | 2432–2759 |
| | | | | | 3018–3144 |
| | | | | | 3495–3735 |
| | | | | | 3740–4301 |
| | | | | | 5392–5513 |
| | | | | | 6102–6215 |
| | | | | | 6948–10751 |
| HNTSS75 | 2649 | 1045506 | AL157408 | 13039 | 1–1676 |
| HODHE60 | 2688 | 1092615 | AC026281 | 13040 | 1–1044 |
| HODHE60 | 2688 | 1092615 | AC026281 | 13041 | 1–108 |
| HOHCJ90 | 2719 | 890046 | AL359384 | 13042 | 1–186 |
| | | | | | 1205–1993 |
| HOHDC86 | 2720 | 1184519 | AC011389 | 13043 | 1–3707 |
| HOSFQ65 | 2740 | 994701 | AC037439 | 13044 | 1–1128 |
| | | | | | 1175–2521 |
| | | | | | 2596–3981 |
| HOSFQ65 | 2740 | 994701 | AC068340 | 13045 | 1–1128 |
| | | | | | 1175–2522 |
| | | | | | 2597–3982 |
| HOSFQ65 | 2740 | 994701 | AC068340 | 13046 | 1–458 |
| HOSFT61 | 2741 | 862050 | AP000315 | 13047 | 1–6367 |
| HOSFT61 | 2741 | 862050 | AP000165 | 13048 | 1–6367 |
| HOSFT61 | 2741 | 862050 | AP000118 | 13049 | 1–6367 |
| HOSFT61 | 2741 | 862050 | AP000315 | 13050 | 1–379 |
| HOSFT61 | 2741 | 862050 | AP000315 | 13051 | 1–526 |
| HOSFT61 | 2741 | 862050 | AP000165 | 13052 | 1–379 |
| HOSFT61 | 2741 | 862050 | AP000165 | 13053 | 1–526 |
| HOSFT61 | 2741 | 862050 | AP000118 | 13054 | 1–379 |
| HOSFT61 | 2741 | 862050 | AP000118 | 13055 | 1–526 |
| HOUCW42 | 2746 | 424084 | AC012533 | 13056 | 1–1076 |
| HOUCW42 | 2746 | 424084 | AC024367 | 13057 | 1–1076 |
| HOUCW42 | 2746 | 424084 | AC024367 | 13058 | 1–366 |
| HOUFU35 | 2751 | 926703 | AC068551 | 13059 | 1–3008 |
| HOUFU35 | 2751 | 926703 | AC021292 | 13060 | 1–3008 |
| HOVAF78 | 2755 | 1028714 | AC016590 | 13061 | 1–1611 |
| HOVAF78 | 2755 | 1028714 | AC016590 | 13062 | 1–338 |
| HOVAZ13 | 2758 | 494302 | AC009477 | 13063 | 1–33 |
| | | | | | 102–283 |
| | | | | | 300–1306 |
| | | | | | 1326–2042 |
| | | | | | 3293–3427 |
| | | | | | 4140–4386 |
| | | | | | 4854–5292 |
| | | | | | 5879–7096 |
| HOVAZ13 | 2758 | 494302 | AC009477 | 13064 | 1–180 |

TABLE 1C-continued

| cDNA Clone ID | SEQ ID NO: X | CONTIG ID: | BAC ID: A | SEQ ID NO: B | EXON From-To |
|---|---|---|---|---|---|
| HOVAZ13 | 2758 | 494302 | AC009477 | 13065 | 520–819 |
| HPBEQ12 | 2769 | 340584 | AC068659 | 13066 | 1–3616 |
|  |  |  |  |  | 1–73 |
|  |  |  |  |  | 344–430 |
|  |  |  |  |  | 513–569 |
|  |  |  |  |  | 867–972 |
|  |  |  |  |  | 1756–1815 |
|  |  |  |  |  | 1899–1953 |
|  |  |  |  |  | 2192–2292 |
|  |  |  |  |  | 2915–2964 |
|  |  |  |  |  | 3101–3141 |
|  |  |  |  |  | 3250–3304 |
|  |  |  |  |  | 3479–3688 |
|  |  |  |  |  | 3921–4125 |
|  |  |  |  |  | 4646–5025 |
|  |  |  |  |  | 5250–7562 |
| HPBEQ12 | 2769 | 340584 | AC010287 | 13067 | 1–73 |
|  |  |  |  |  | 344–430 |
|  |  |  |  |  | 513–569 |
|  |  |  |  |  | 867–972 |
|  |  |  |  |  | 1756–1815 |
|  |  |  |  |  | 1899–1953 |
|  |  |  |  |  | 2192–2292 |
|  |  |  |  |  | 2915–2964 |
|  |  |  |  |  | 3101–3141 |
|  |  |  |  |  | 3250–3312 |
|  |  |  |  |  | 3479–3686 |
|  |  |  |  |  | 3919–4123 |
|  |  |  |  |  | 4644–5023 |
|  |  |  |  |  | 5248–7560 |
| HPEAB57 | 2774 | 519360 | AL355676 | 13068 | 1–427 |
| HPEAB57 | 2774 | 519360 | AL355676 | 13069 | 1–98 |
| HPFCR13 | 2783 | 1352210 | AC011500 | 13070 | 1–1930 |
| HPFCR13 | 2783 | 1352210 | AC011500 | 13071 | 1–128 |
| HPFCR13 | 2783 | 1352210 | AC011500 | 13072 | 1–126 |
| HPFCR15 | 2784 | 422937 | AC040929 | 13073 | 1–980 |
| HPFCR15 | 2784 | 422937 | AC069353 | 13074 | 1–980 |
| HPFCR15 | 2784 | 422937 | AC025646 | 13075 | 1–980 |
| HPFCR15 | 2784 | 422937 | AC040929 | 13076 | 1–338 |
| HPFCR15 | 2784 | 422937 | AC069353 | 13077 | 1–337 |
| HPFCR15 | 2784 | 422937 | AC025646 | 13078 | 1–338 |
| HPICC86 | 2794 | 906529 | AL031768 | 13079 | 1–2050 |
|  |  |  |  |  | 2058–5335 |
| HPJAP43 | 2795 | 926704 | AL136082 | 13080 | 1–213 |
|  |  |  |  |  | 2650–6246 |
|  |  |  |  |  | 6382–6771 |
|  |  |  |  |  | 7494–9002 |
|  |  |  |  |  | 9077–9193 |
|  |  |  |  |  | 9234–9908 |
|  |  |  |  |  | 9912–15057 |
| HPJAP43 | 2795 | 926704 | AL136082 | 13081 | 1–803 |
| HPJBK11 | 2797 | 1038476 | AL162426 | 13082 | 1–2878 |
| HPJCC05 | 2799 | 917086 | AC005856 | 13083 | 1–689 |
|  |  |  |  |  | 1669–1856 |
|  |  |  |  |  | 2051–2346 |
|  |  |  |  |  | 3400–4848 |
|  |  |  |  |  | 6832–9044 |
| HPJCG42 | 2800 | 1004026 | AC055711 | 13084 | 1–2194 |
| HPJCG42 | 2800 | 1004026 | AC069430 | 13085 | 1–2194 |
| HPJCG42 | 2800 | 1004026 | AC069241 | 13086 | 1–2194 |
| HPJCG42 | 2800 | 1004026 | AC055711 | 13087 | 1–312 |
| HPJCG42 | 2800 | 1004026 | AC069430 | 13088 | 1–312 |
| HPJCG42 | 2800 | 1004026 | AC069241 | 13089 | 1–312 |
| HPJCT08 | 2804 | 910132 | AC009796 | 13090 | 1–2333 |
| HPJCT08 | 2804 | 910132 | AC027641 | 13091 | 1–2332 |
| HPJCT08 | 2804 | 910132 | AC009796 | 13092 | 1–163 |
|  |  |  |  |  | 686–788 |
|  |  |  |  |  | 1306–1395 |
|  |  |  |  |  | 1447–1827 |
|  |  |  |  |  | 1914–2721 |
|  |  |  |  |  | 2804–3321 |
| HPJCT08 | 2804 | 910132 | AC027641 | 13093 | 1–459 |
| HPJDA23 | 2805 | 1034454 | AC067740 | 13094 | 1–2444 |
| HPJDA23 | 2805 | 1034454 | AC068415 | 13095 | 1–601 |
| HPJDM47 | 2806 | 1035597 | AC010206 | 13096 | 1–2214 |
| HPJDM47 | 2806 | 1035597 | AC008119 | 13097 | 1–2214 |
| HPJDM47 | 2806 | 1035597 | AC010206 | 13098 | 1–318 |
| HPJDM47 | 2806 | 1035597 | AC008119 | 13099 | 1–308 |
| HPJEC20 | 2807 | 1035599 | AC074012 | 13100 | 1–2701 |
| HPJEC20 | 2807 | 1035599 | AC074012 | 13101 | 1–100 |
| HPJEC20 | 2807 | 1035599 | AC074012 | 13102 | 1–141 |
| HPJEG57 | 2809 | 1082921 | AC015909 | 13103 | 1–1505 |
| HPJEG57 | 2809 | 1082921 | AC073970 | 13104 | 1–1504 |
| HPJEG57 | 2809 | 1082921 | AC015909 | 13105 | 1–290 |
| HPJEV11 | 2810 | 1035601 | AF053356 | 13106 | 1–618 |
| HPJEV11 | 2810 | 1035601 | AC009488 | 13107 | 1–618 |
| HPJEV11 | 2810 | 1035601 | AF053356 | 13108 | 1–153 |
|  |  |  |  |  | 1905–2552 |
|  |  |  |  |  | 2663–3891 |
|  |  |  |  |  | 3980–4048 |
|  |  |  |  |  | 4307–4531 |
|  |  |  |  |  | 4621–4860 |
|  |  |  |  |  | 4919–5516 |
| HPJEV11 | 2810 | 1035601 | AF053356 | 13109 | 1–386 |
| HPJEV11 | 2810 | 1035601 | AC009488 | 13110 | 1–386 |
| HPJEV11 | 2810 | 1035601 | AC009488 | 13111 | 1–150 |
| HPMBU33 | 2817 | 371776 | AL355142 | 13112 | 1–736 |
| HPMBU33 | 2817 | 371776 | AC027407 | 13113 | 1–736 |
| HPMBU33 | 2817 | 371776 | AL355142 | 13114 | 1–475 |
| HPMBU33 | 2817 | 371776 | AC027407 | 13115 | 1–475 |
| HPMGQ80 | 2834 | 1352292 | AC021468 | 13116 | 1–1431 |
| HPMGQ80 | 2834 | 1352292 | AC011365 | 13117 | 1–2504 |
| HPMGQ80 | 2834 | 1352292 | AC008590 | 13118 | 1–2504 |
| HPMGQ80 | 2834 | 1352292 | AC021468 | 13119 | 1–703 |
| HPMGQ80 | 2834 | 1352292 | AC008590 | 13120 | 1–1251 |
|  |  |  |  |  | 3991–4201 |
|  |  |  |  |  | 5411–5698 |
|  |  |  |  |  | 6682–7000 |
|  |  |  |  |  | 7007–7705 |
| HPRCE33 | 2841 | 1037921 | AC005332 | 13121 | 1–4919 |
|  |  |  |  |  | 5291–6672 |
|  |  |  |  |  | 6717–7030 |
|  |  |  |  |  | 8371–10088 |
| HPRCE33 | 2841 | 1037921 | AC005332 | 13122 | 1–132 |
| HPRCE33 | 2841 | 1037921 | AC005332 | 13123 | 1–351 |
|  |  |  |  |  | 874–1282 |
|  |  |  |  |  | 1399–3412 |
| HPTRH45 | 2848 | 853832 | AC009946 | 13124 | 1–142 |
|  |  |  |  |  | 514–552 |
|  |  |  |  |  | 2592–2691 |
|  |  |  |  |  | 3413–3709 |
|  |  |  |  |  | 5569–5923 |
|  |  |  |  |  | 9429–9579 |
|  |  |  |  |  | 10998–11766 |
| HPTRH45 | 2848 | 853832 | AC009946 | 13125 | 1–263 |
| HRABV43 | 2865 | 1024909 | AC051660 | 13126 | 1–64 |
|  |  |  |  |  | 334–757 |
|  |  |  |  |  | 899–1050 |
|  |  |  |  |  | 1198–1599 |
|  |  |  |  |  | 1738–1891 |
|  |  |  |  |  | 2098–2392 |
|  |  |  |  |  | 2922–3049 |
|  |  |  |  |  | 3142–3244 |
|  |  |  |  |  | 3319–3389 |
|  |  |  |  |  | 3482–3598 |
|  |  |  |  |  | 3691–3857 |
|  |  |  |  |  | 4138–4515 |
|  |  |  |  |  | 4601–4789 |
|  |  |  |  |  | 4828–8792 |
|  |  |  |  |  | 8903–9039 |
|  |  |  |  |  | 9865–10042 |
|  |  |  |  |  | 11509–11797 |
|  |  |  |  |  | 12091–12259 |
| HRABV43 | 2865 | 1024909 | AC051660 | 13127 | 1–1585 |
| HRADO01 | 2870 | 1018804 | AL139021 | 13128 | 1–50 |
|  |  |  |  |  | 1680–1790 |
|  |  |  |  |  | 2129–2228 |
|  |  |  |  |  | 2277–2398 |
|  |  |  |  |  | 2534–3371 |
|  |  |  |  |  | 3449–5383 |
|  |  |  |  |  | 6350–7047 |
| HRADO01 | 2870 | 1018804 | AL132989 | 13129 | 1–1941 |

TABLE 1C-continued

| cDNA Clone ID | SEQ ID NO: X | CONTIG ID: | BAC ID: A | SEQ ID NO: B | EXON From-To |
|---|---|---|---|---|---|
| HRADO01 | 2870 | 1018804 | AL139021 | 13130 | 1–447 |
| HRADO01 | 2870 | 1018804 | AL132989 | 13131 | 1–111 |
| | | | | | 626–726 |
| | | | | | 862–1699 |
| HRDDS01 | 2876 | 456533 | AL031733 | 13132 | 1–126 |
| | | | | | 935–1444 |
| | | | | | 2781–3007 |
| | | | | | 3782–4133 |
| HRDDS01 | 2876 | 456533 | AL356532 | 13133 | 1–126 |
| | | | | | 935–1444 |
| | | | | | 2780–3006 |
| | | | | | 3817–4129 |
| HROBM46 | 2899 | 1035383 | AC069259 | 13134 | 1–524 |
| | | | | | 540–1316 |
| HROBM46 | 2899 | 1035383 | AC069259 | 13135 | 1–561 |
| HRSMQ86 | 2904 | 985877 | AC007200 | 13136 | 1–569 |
| HRSMQ86 | 2904 | 985877 | AC008677 | 13137 | 1–569 |
| HRSMQ86 | 2904 | 985877 | AC007200 | 13138 | 1–411 |
| HRSMQ86 | 2904 | 985877 | AC008677 | 13139 | 1–411 |
| HSAUA82 | 2911 | 1027249 | AC020991 | 13140 | 1–86 |
| HSAUA82 | 2911 | 1027249 | AC069380 | 13141 | 1–238 |
| HSAUA82 | 2911 | 1027249 | AC021162 | 13142 | 1–116 |
| HSAUA82 | 2911 | 1027249 | AL161457 | 13143 | 1–89 |
| HSAUA82 | 2911 | 1027249 | AL353799 | 13144 | 1–97 |
| HSAUA82 | 2911 | 1027249 | AC009562 | 13145 | 1–95 |
| HSAUA82 | 2911 | 1027249 | AP000655 | 13146 | 1–103 |
| HSAUA82 | 2911 | 1027249 | AC026627 | 13147 | 1–1645 |
| HSAUA82 | 2911 | 1027249 | AC026627 | 13148 | 1–543 |
| HSDAJS3 | 2943 | 938661 | AC026073 | 13149 | 1–659 |
| HSDAJ53 | 2943 | 938661 | AC019136 | 13150 | 1–659 |
| HSDAJ53 | 2943 | 938661 | AC026073 | 13151 | 1–322 |
| HSDAJ53 | 2943 | 938661 | AC019136 | 13152 | 1–322 |
| HSDJL42 | 2963 | 1036471 | AC008676 | 13153 | 1–56 |
| | | | | | 571–2959 |
| HSICQ15 | 2980 | 1044613 | AC020931 | 13154 | 1–316 |
| | | | | | 795–921 |
| | | | | | 1120–1169 |
| | | | | | 1309–1676 |
| | | | | | 1983–2149 |
| | | | | | 2167–2419 |
| | | | | | 3185–3564 |
| | | | | | 3694–3917 |
| | | | | | 4926–5498 |
| | | | | | 5869–7117 |
| | | | | | 7213–7816 |
| | | | | | 8019–8311 |
| | | | | | 8627–8807 |
| | | | | | 9723–9815 |
| HSICQ15 | 2980 | 1044613 | AC020931 | 13155 | 1–283 |
| HSICQ15 | 2980 | 1044613 | AC020931 | 13156 | 1–278 |
| HSIGD79 | 2996 | 1034395 | AL109613 | 13157 | 1–123 |
| | | | | | 517–660 |
| | | | | | 831–1525 |
| | | | | | 1865–2107 |
| | | | | | 2871–3282 |
| | | | | | 4045–4368 |
| | | | | | 5908–6041 |
| | | | | | 6399–6806 |
| | | | | | 8342–8499 |
| | | | | | 10012–10279 |
| | | | | | 10307–13830 |
| HSIGD79 | 2996 | 1034395 | AL359820 | 13158 | 1–3304 |
| HSIGD79 | 2996 | 1034395 | AC022939 | 13159 | 1–243 |
| | | | | | 1007–1418 |
| | | | | | 2181–2504 |
| | | | | | 4043–4176 |
| | | | | | 4534–4941 |
| | | | | | 6477–6634 |
| | | | | | 8146–8413 |
| | | | | | 8441–11964 |
| HSIGD79 | 2996 | 1034395 | AL109613 | 13160 | 1–400 |
| HSIGD79 | 2996 | 1034395 | AL109613 | 13161 | 1–459 |
| HSIGD79 | 2996 | 1034395 | AL359820 | 13162 | 1–458 |
| HSIGD79 | 2996 | 1034395 | AC022939 | 13163 | 1–459 |
| HSKGQ58 | 3009 | 1310500 | AL359317 | 13164 | 1–258 |
| | | | | | 1656–1790 |
| | | | | | 1861–2289 |
| | | | | | 2583–3098 |
| | | | | | 5883–6217 |
| | | | | | 7232–7338 |
| | | | | | 7592–7727 |
| | | | | | 8760–9114 |
| | | | | | 9826–10213 |
| | | | | | 11852–15205 |
| HSLCP57 | 3023 | 1352385 | AC069516 | 13165 | 1–1766 |
| | | | | | 1823–2137 |
| | | | | | 2173–3119 |
| HSLCP57 | 3023 | 1352385 | AC048334 | 13166 | 1–1886 |
| | | | | | 1943–2257 |
| | | | | | 2293–3239 |
| HSLDS06 | 3029 | 1352404 | AL159140 | 13167 | 1–808 |
| HSLDS06 | 3029 | 1352404 | AL162471 | 13168 | 1–808 |
| HSLDS06 | 3029 | 1352404 | AC024945 | 13169 | 1–808 |
| HSLDS06 | 3029 | 1352404 | AL159140 | 13170 | 1–434 |
| HSLDS06 | 3029 | 1352404 | AL159140 | 13171 | 1–318 |
| HSLDS06 | 3029 | 1352404 | AL162471 | 13172 | 1–318 |
| HSLDS06 | 3029 | 1352404 | AL162471 | 13173 | 1–434 |
| HSLDS06 | 3029 | 1352404 | AC024945 | 13174 | 1–318 |
| HSLDS06 | 3029 | 1352404 | AC024945 | 13175 | 1–434 |
| HSLEF58 | 3031 | 1046267 | AC024468 | 13176 | 1–269 |
| | | | | | 2419–2560 |
| | | | | | 3305–3786 |
| | | | | | 4474–5582 |
| | | | | | 5736–6454 |
| | | | | | 6554–8813 |
| | | | | | 9717–9903 |
| HSLEF58 | 3031 | 1046267 | AL162612 | 13177 | 1–155 |
| | | | | | 168–272 |
| | | | | | 2427–2570 |
| | | | | | 3309–3957 |
| | | | | | 4477–4628 |
| | | | | | 4630–4944 |
| | | | | | 4986–5499 |
| | | | | | 5827–6313 |
| | | | | | 6597–8596 |
| | | | | | 9375–9620 |
| HSLEF58 | 3031 | 1046267 | AL358813 | 13178 | 1–154 |
| | | | | | 168–272 |
| | | | | | 2427–2570 |
| | | | | | 3307–3955 |
| | | | | | 4488–4638 |
| | | | | | 4640–5508 |
| | | | | | 5813–6298 |
| | | | | | 6577–8556 |
| HSLEF58 | 3031 | 1046267 | AC018593 | 13179 | 1–154 |
| | | | | | 168–272 |
| | | | | | 2428–2571 |
| | | | | | 3308–3956 |
| | | | | | 4489–4639 |
| | | | | | 4641–5509 |
| | | | | | 5814–6299 |
| | | | | | 6578–8557 |
| HSLEF58 | 3031 | 1046267 | AC025992 | 13180 | 1–154 |
| | | | | | 168–272 |
| | | | | | 2428–2571 |
| | | | | | 3309–3957 |
| | | | | | 4490–4640 |
| | | | | | 4642–5510 |
| | | | | | 5815–6300 |
| | | | | | 6579–8558 |
| HSLEF58 | 3031 | 1046267 | AC024468 | 13181 | 1–478 |
| HSLEF58 | 3031 | 1046267 | AC024468 | 13182 | 1–835 |
| HSLEF58 | 3031 | 1046267 | AL162612 | 13183 | 1–379 |
| HSLEF58 | 3031 | 1046267 | AL162612 | 13184 | 1–579 |
| HSLEF58 | 3031 | 1046267 | AL358813 | 13185 | 1–246 |
| HSLEF58 | 3031 | 1046267 | AL358813 | 13186 | 1–579 |
| HSLEF58 | 3031 | 1046267 | AC018593 | 13187 | 1–579 |
| HSLEF58 | 3031 | 1046267 | AC018593 | 13188 | 1–246 |
| HSLEFS8 | 3031 | 1046267 | AC025992 | 13189 | 1–579 |
| HSLGM21 | 3035 | 990815 | AC025936 | 13190 | 1–1702 |
| HSLGM21 | 3035 | 990815 | AC025936 | 13191 | 1–1100 |
| HSLHI86 | 3038 | 1056298 | AC078898 | 13192 | 1–640 |

TABLE 1C-continued

| cDNA Clone ID | SEQ ID NO: X | CONTIG ID: | BAC ID: A | SEQ ID NO: B | EXON From-To |
|---|---|---|---|---|---|
| HSLHI86 | 3038 | 1056298 | AC074196 | 13193 | 1–606 |
| HSLHI86 | 3038 | 1056298 | AC077693 | 13194 | 1–628 |
| HSLHI86 | 3038 | 1056298 | AC027037 | 13195 | 1–640 |
| HSLHI86 | 3038 | 1056298 | AC026757 | 13196 | 1–513 |
| HSLHI86 | 3038 | 1056298 | AC027036 | 13197 | 1–612 |
| HSLHI86 | 3038 | 1056298 | AC074108 | 13198 | 1–462 |
| HSLHI86 | 3038 | 1056298 | AC074226 | 13199 | 1–640 |
| HSLHI86 | 3038 | 1056298 | AC073166 | 13200 | 1–640 |
| HSLHI86 | 3038 | 1056298 | AC068667 | 13201 | 1–654 |
| HSLHI86 | 3038 | 1056298 | AC024594 | 13202 | 1–414 |
| HSLHI86 | 3038 | 1056298 | AC024261 | 13203 | 1–647 |
| HSLHI86 | 3038 | 1056298 | AC073548 | 13204 | 1–103 |
|  |  |  |  |  | 326–451 |
|  |  |  |  |  | 467–618 |
|  |  |  |  |  | 2617–2871 |
|  |  |  |  |  | 3563–3646 |
|  |  |  |  |  | 4539–5136 |
|  |  |  |  |  | 7229–7450 |
|  |  |  |  |  | 8403–8525 |
|  |  |  |  |  | 8565–8585 |
|  |  |  |  |  | 8692–9203 |
|  |  |  |  |  | 11729–11910 |
|  |  |  |  |  | 12165–12493 |
|  |  |  |  |  | 12646–12970 |
|  |  |  |  |  | 13069–13298 |
|  |  |  |  |  | 17441–17657 |
|  |  |  |  |  | 18312–18417 |
|  |  |  |  |  | 18469–18938 |
|  |  |  |  |  | 20179–20424 |
|  |  |  |  |  | 20634–20811 |
|  |  |  |  |  | 21140–21275 |
|  |  |  |  |  | 21630–21703 |
|  |  |  |  |  | 21812–21917 |
|  |  |  |  |  | 23918–24393 |
|  |  |  |  |  | 24454–24742 |
|  |  |  |  |  | 25561–25739 |
|  |  |  |  |  | 25743–27750 |
| HSLHI86 | 3038 | 1056298 | AC078893 | 13205 | 1–640 |
| HSLHI86 | 3038 | 1056298 | AC073555 | 13206 | 1–640 |
| HSLHI86 | 3038 | 1056298 | AC069474 | 13207 | 1–571 |
| HSLHI86 | 3038 | 1056298 | AC068924 | 13208 | 1–640 |
| HSLHI86 | 3038 | 1056298 | AC066689 | 13209 | 1–639 |
| HSLHI86 | 3038 | 1056298 | AC035249 | 13210 | 1–397 |
| HSLHI86 | 3038 | 1056298 | AC034258 | 13211 | 1–648 |
| HSLHI86 | 3038 | 1056298 | AC027135 | 13212 | 1–434 |
| HSLHI86 | 3038 | 1056298 | AC027035 | 13213 | 1–624 |
| HSLHI86 | 3038 | 1056298 | AC027034 | 13214 | 1–509 |
| HSLHI86 | 3038 | 1056298 | AC026815 | 13215 | 1–654 |
| HSLHI86 | 3038 | 1056298 | AC025815 | 13216 | 1–380 |
| HSLHI86 | 3038 | 1056298 | AC025781 | 13217 | 1–546 |
| HSLHI86 | 3038 | 1056298 | AC078894 | 13218 | 1–654 |
| HSLHI86 | 3038 | 1056298 | AC073548 | 13219 | 1–112 |
| HSLIA81 | 3040 | 1204150 | AC073846 | 13220 | 1–2059 |
|  |  |  |  |  | 2123–3471 |
| HSLIA81 | 3040 | 1204150 | AC073846 | 13221 | 1–359 |
| HSLIA81 | 3040 | 1204150 | AC073846 | 13222 | 1–573 |
| HSNAQ47 | 3044 | 847453 | AC024468 | 13223 | 1–835 |
| HSNAQ47 | 3044 | 847453 | AL162612 | 13224 | 1–3929 |
| HSNAQ47 | 3044 | 847453 | AC018593 | 13225 | 1–3928 |
| HSNAQ47 | 3044 | 847453 | AC025992 | 13226 | 1–3928 |
| HSNAQ47 | 3044 | 847453 | AC024468 | 13227 | 1–269 |
|  |  |  |  |  | 2419–2560 |
|  |  |  |  |  | 3305–3786 |
|  |  |  |  |  | 4474–5582 |
|  |  |  |  |  | 5736–6454 |
|  |  |  |  |  | 6554–8813 |
|  |  |  |  |  | 9717–9903 |
| HSNAQ47 | 3044 | 847453 | AL162612 | 13228 | 1–379 |
| HSNAQ47 | 3044 | 847453 | AC018593 | 13229 | 1–379 |
| HSNAQ47 | 3044 | 847453 | AC025992 | 13230 | 1–379 |
| HSOAH66 | 3051 | 456540 | AC024502 | 13231 | 1–163 |
| HSOAH66 | 3051 | 456540 | AC016124 | 13232 | 1–115 |
| HSOAH66 | 3051 | 456540 | AL356584 | 13233 | 1–117 |
| HSOAH66 | 3051 | 456540 | AC022025 | 13234 | 1–141 |
| HSOAH66 | 3051 | 456540 | AC018994 | 13235 | 1–1160 |
| HSPBY63 | 3060 | 1009601 | AL390779 | 13236 | 1–94 |
| HSPBY63 | 3060 | 1009601 | AP000879 | 13237 | 1–1953 |
| HSPBY63 | 3060 | 1009601 | AP000879 | 13238 | 1–299 |
| HSPBY63 | 3060 | 1009601 | AP000879 | 13239 | 1–424 |
| HSUMA53 | 3088 | 1235570 | AC018673 | 13240 | 1–136 |
|  |  |  |  |  | 1404–1691 |
|  |  |  |  |  | 5837–5966 |
|  |  |  |  |  | 6337–6437 |
|  |  |  |  |  | 7858–7925 |
| HSUMA53 | 3088 | 1235570 | AC018673 | 13241 | 1–388 |
| HSUMA53 | 3088 | 1235570 | AC018673 | 13242 | 1–92 |
| HSWBJ74 | 3112 | 864579 | AC008865 | 13243 | 1–951 |
|  |  |  |  |  | 1760–2147 |
|  |  |  |  |  | 2205–4944 |
| HSWBJ74 | 3112 | 864579 | AC008850 | 13244 | 1–717 |
|  |  |  |  |  | 740–792 |
|  |  |  |  |  | 846–2773 |
| HSWBJ74 | 3112 | 864579 | AC008865 | 13245 | 1–512 |
| HSWBJ74 | 3112 | 864579 | AC008850 | 13246 | 1–388 |
| HT4ES80 | 3139 | 902835 | AC004789 | 13247 | 1–167 |
|  |  |  |  |  | 683–786 |
|  |  |  |  |  | 935–987 |
|  |  |  |  |  | 1064–1209 |
|  |  |  |  |  | 1600–1709 |
|  |  |  |  |  | 1790–1874 |
|  |  |  |  |  | 2317–4795 |
|  |  |  |  |  | 4892–4983 |
|  |  |  |  |  | 6400–6515 |
|  |  |  |  |  | 6776–6865 |
|  |  |  |  |  | 6986–7608 |
| HT4ES80 | 3139 | 902835 | AC012676 | 13248 | 1–167 |
|  |  |  |  |  | 683–786 |
|  |  |  |  |  | 935–987 |
|  |  |  |  |  | 1064–1209 |
|  |  |  |  |  | 1600–1709 |
|  |  |  |  |  | 1790–1874 |
|  |  |  |  |  | 2317–4796 |
|  |  |  |  |  | 4893–4984 |
|  |  |  |  |  | 6386–6515 |
|  |  |  |  |  | 6778–6867 |
|  |  |  |  |  | 6988–7610 |
| HT4ES80 | 3139 | 902835 | AC004789 | 13249 | 1–102 |
| HT4ES80 | 3139 | 902835 | AC004789 | 13250 | 1–678 |
| HT4ES80 | 3139 | 902835 | AC012676 | 13251 | 1–678 |
| HT4ES80 | 3139 | 902835 | AC012676 | 13252 | 1–102 |
| HT5EK75 | 3141 | 1085443 | AC015778 | 13253 | 1–2013 |
|  |  |  |  |  | 6320–7108 |
|  |  |  |  |  | 8789–9160 |
|  |  |  |  |  | 9749–10085 |
|  |  |  |  |  | 11396–11588 |
|  |  |  |  |  | 11645–11993 |
|  |  |  |  |  | 12914–13486 |
|  |  |  |  |  | 14163–14525 |
| HT5EK75 | 3141 | 1085443 | AC023242 | 13254 | 1–86 |
| HT5EK75 | 3141 | 1085443 | AC060225 | 13255 | 1–2013 |
|  |  |  |  |  | 6320–7107 |
|  |  |  |  |  | 8788–9159 |
|  |  |  |  |  | 9748–10084 |
|  |  |  |  |  | 11395–11587 |
|  |  |  |  |  | 11644–11992 |
|  |  |  |  |  | 12912–13484 |
|  |  |  |  |  | 14161–14523 |
| HT5EK75 | 3141 | 1085443 | AC009453 | 13256 | 1–143 |
| HT5EK75 | 3141 | 1085443 | AL359092 | 13257 | 1–116 |
| HTABP30 | 3143 | 1009582 | AL109916 | 13258 | 1–308 |
|  |  |  |  |  | 729–850 |
|  |  |  |  |  | 1561–2316 |
|  |  |  |  |  | 2537–2843 |
|  |  |  |  |  | 4126–4231 |
|  |  |  |  |  | 5192–9038 |
| HTABP30 | 3143 | 1009582 | AL109916 | 13259 | 1–576 |
| HTADC09 | 3146 | 1159039 | AC005740 | 13260 | 1–477 |
|  |  |  |  |  | 743–1093 |
|  |  |  |  |  | 1601–1973 |
|  |  |  |  |  | 2653–3336 |
|  |  |  |  |  | 3487–6735 |
|  |  |  |  |  | 6910–7038 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 7213–7317 |
| | | | | | 7329–8051 |
| | | | | | 9152–10208 |
| | | | | | 10293–11443 |
| | | | | | 11593–12545 |
| | | | | | 12811–13152 |
| | | | | | 13422–13481 |
| | | | | | 13601–14334 |
| | | | | | 14418–14524 |
| | | | | | 14625–14713 |
| | | | | | 14958–15119 |
| | | | | | 15309–15446 |
| | | | | | 16402–16558 |
| | | | | | 19172–19292 |
| | | | | | 19680–19767 |
| | | | | | 20000–20121 |
| | | | | | 20728–20869 |
| HTADC09 | 3146 | 1159039 | AC005740 | 13261 | 1–2469 |
| | | | | | 2938–3229 |
| | | | | | 5273–5782 |
| | | | | | 6611–6709 |
| | | | | | 7387–7969 |
| | | | | | 8404–8801 |
| | | | | | 9433–9896 |
| | | | | | 12391–13237 |
| HTADC09 | 3146 | 1159039 | AC005740 | 13262 | 1–173 |
| HTADV27 | 3150 | 1352173 | AC004227 | 13263 | 1–1235 |
| HTADV27 | 3150 | 1352173 | AC004227 | 13264 | 1–660 |
| HTADV27 | 3150 | 1352173 | AC004227 | 13265 | 1–271 |
| HTEDJ85 | 3174 | 1184544 | AL158826 | 13266 | 1–106 |
| | | | | | 198–323 |
| | | | | | 1064–1206 |
| | | | | | 1529–1610 |
| | | | | | 1934–3350 |
| | | | | | 4085–4161 |
| | | | | | 5048–5121 |
| | | | | | 7260–7315 |
| HTEDJ85 | 3174 | 1184544 | AC002099 | 13267 | 1–105 |
| | | | | | 198–323 |
| | | | | | 1064–1206 |
| | | | | | 1529–1610 |
| | | | | | 1934–3350 |
| | | | | | 3653–3932 |
| | | | | | 4085–4350 |
| | | | | | 5047–5123 |
| | | | | | 5402–5538 |
| | | | | | 5958–6371 |
| | | | | | 7263–7357 |
| | | | | | 8125–8213 |
| | | | | | 8581–8776 |
| | | | | | 9061–9204 |
| | | | | | 10949–11297 |
| | | | | | 11696–12032 |
| | | | | | 12219–12554 |
| | | | | | 13904–14319 |
| HTEDJ85 | 3174 | 1184544 | AC002355 | 13268 | 1–107 |
| | | | | | 202–328 |
| | | | | | 1072–1224 |
| | | | | | 1550–1621 |
| | | | | | 1946–3369 |
| | | | | | 3672–3952 |
| | | | | | 4106–4371 |
| | | | | | 5067–5143 |
| | | | | | 5422–5558 |
| | | | | | 5979–6393 |
| | | | | | 7286–7380 |
| | | | | | 8149–8237 |
| | | | | | 8605–8800 |
| | | | | | 9086–9230 |
| | | | | | 10979–11327 |
| | | | | | 11726–12062 |
| | | | | | 12249–12584 |
| | | | | | 13938–14353 |
| HTEDJ85 | 3174 | 1184544 | AC002099 | 13269 | 1–471 |
| | | | | | 1088–1667 |
| | | | | | 2560–2646 |
| HTEDJ85 | 3174 | 1184544 | AC002355 | 13270 | 1–473 |
| | | | | | 1094–1674 |
| | | | | | 2573–2659 |
| HTEGF16 | 3180 | 1160908 | AL034380 | 13271 | 1–650 |
| | | | | | 811–1114 |
| | | | | | 1774–1874 |
| | | | | | 2743–3224 |
| | | | | | 3603–3740 |
| | | | | | 5159–5507 |
| | | | | | 5757–5987 |
| | | | | | 6956–8194 |
| | | | | | 9011–9590 |
| | | | | | 9894–10331 |
| | | | | | 10407–11242 |
| HTEGF16 | 3180 | 1160908 | AL034380 | 13272 | 1–276 |
| HTEGF16 | 3180 | 1160908 | AL034380 | 13273 | 1–319 |
| HTEMD27 | 3198 | 1137817 | AC040162 | 13274 | 1–123 |
| | | | | | 253–407 |
| | | | | | 526–637 |
| | | | | | 683–941 |
| | | | | | 1036–1144 |
| | | | | | 1318–1633 |
| | | | | | 1719–2170 |
| | | | | | 2232–2580 |
| | | | | | 2836–3271 |
| | | | | | 3330–4409 |
| | | | | | 4650–5220 |
| | | | | | 5319–5457 |
| | | | | | 5577–5713 |
| | | | | | 5793–6112 |
| | | | | | 7316–7480 |
| | | | | | 7607–7666 |
| | | | | | 8418–8642 |
| | | | | | 8739–8864 |
| HTEMD27 | 3198 | 1137817 | AC040162 | 13275 | 1–483 |
| HTEMD27 | 3198 | 1137817 | AC040162 | 13276 | 1–109 |
| HTEME02 | 3199 | 1079428 | AC002544 | 13277 | 1–172 |
| | | | | | 936–1701 |
| | | | | | 2077–2609 |
| | | | | | 2806–2936 |
| | | | | | 2991–4352 |
| | | | | | 5036–5242 |
| | | | | | 5985–6254 |
| | | | | | 7457–7554 |
| | | | | | 7663–8354 |
| | | | | | 8707–14260 |
| HTEME02 | 3199 | 1079428 | AC002425 | 13278 | 1–858 |
| | | | | | 947–1189 |
| | | | | | 1348–1519 |
| | | | | | 2137–4084 |
| | | | | | 4163–4293 |
| | | | | | 4308–6278 |
| | | | | | 6393–6599 |
| | | | | | 6969–7134 |
| | | | | | 7342–7828 |
| | | | | | 8170–8479 |
| | | | | | 8506–8589 |
| | | | | | 8613–9712 |
| HTEME02 | 3199 | 1079428 | AC009053 | 13279 | 1–172 |
| | | | | | 794–2744 |
| | | | | | 2823–2953 |
| | | | | | 2963–4940 |
| | | | | | 5635–5800 |
| | | | | | 6008–6494 |
| | | | | | 6520–6635 |
| | | | | | 6835–7144 |
| | | | | | 7167–7250 |
| | | | | | 7274–8372 |
| | | | | | 8590–14260 |
| HTEME02 | 3199 | 1079428 | AC008956 | 13280 | 1–858 |
| | | | | | 947–1189 |
| | | | | | 1346–1517 |
| | | | | | 1694–1849 |
| | | | | | 1912–2092 |
| | | | | | 2135–4081 |
| | | | | | 4159–4288 |

TABLE 1C-continued

| cDNA Clone ID | SEQ ID NO: X | CONTIG ID: | BAC ID: A | SEQ ID NO: B | EXON From-To |
|---|---|---|---|---|---|
| HTEME02 | 3199 | 1079428 | AC009153 | 13281 | 4298–5639 |
| | | | | | 1–504 |
| | | | | | 563–848 |
| | | | | | 940–2744 |
| | | | | | 2823–2953 |
| | | | | | 2963–4939 |
| | | | | | 5634–5799 |
| | | | | | 6007–6493 |
| | | | | | 6500–6644 |
| | | | | | 7273–8371 |
| | | | | | 8589–14258 |
| HTEME02 | 3199 | 1079428 | AC002544 | 13282 | 1–930 |
| | | | | | 940–1905 |
| HTEME02 | 3199 | 1079428 | AC002544 | 13283 | 1–858 |
| HTEME02 | 3199 | 1079428 | AC002425 | 13284 | 1–465 |
| HTEME02 | 3199 | 1079428 | AC002425 | 13285 | 1–1033 |
| HTEME02 | 3199 | 1079428 | AC009053 | 13286 | 1–1625 |
| HTEME02 | 3199 | 1079428 | AC008956 | 13287 | 1–465 |
| HTEME02 | 3199 | 1079428 | AC009153 | 13288 | 1–1625 |
| HTFOS57 | 3205 | 1143810 | AL357874 | 13289 | 1–184 |
| | | | | | 366–461 |
| | | | | | 724–845 |
| | | | | | 1091–1208 |
| | | | | | 1824–2271 |
| | | | | | 2469–2704 |
| | | | | | 2948–3037 |
| | | | | | 3211–3782 |
| | | | | | 3822–5207 |
| | | | | | 5369–5873 |
| | | | | | 5905–6341 |
| | | | | | 6488–6643 |
| | | | | | 6730–6896 |
| HTFOS57 | 3205 | 1143810 | AL357874 | 13290 | 1–258 |
| HTGGO35 | 3215 | 954651 | AC063925 | 13291 | 1–1096 |
| | | | | | 1465–2140 |
| | | | | | 2680–2941 |
| | | | | | 3903–7914 |
| HTGGO35 | 3215 | 954651 | AC012557 | 13292 | 1–3808 |
| HTGGO35 | 3215 | 954651 | AC063925 | 13293 | 1–765 |
| | | | | | 1266–3352 |
| | | | | | 4065–4624 |
| | | | | | 4989–5380 |
| | | | | | 5510–5664 |
| | | | | | 5675–5735 |
| | | | | | 5925–6191 |
| | | | | | 6527–8225 |
| | | | | | 8729–10306 |
| | | | | | 10398–10817 |
| | | | | | 10923–11259 |
| | | | | | 12329–12881 |
| | | | | | 13183–14085 |
| | | | | | 14097–14550 |
| | | | | | 14578–14688 |
| | | | | | 14742–15422 |
| | | | | | 15486–15903 |
| | | | | | 18295–18501 |
| | | | | | 18621–18910 |
| | | | | | 19245–19480 |
| HTGGO35 | 3215 | 954651 | AC063925 | 13294 | 1–122 |
| HTGGO35 | 3215 | 954651 | AC012557 | 13295 | 1–765 |
| | | | | | 1266–3350 |
| | | | | | 4064–4624 |
| | | | | | 4989–5380 |
| | | | | | 5510–5664 |
| | | | | | 5675–5735 |
| | | | | | 5926–6192 |
| | | | | | 6528–8226 |
| | | | | | 8730–10307 |
| | | | | | 10399–10818 |
| | | | | | 10924–11260 |
| | | | | | 12329–12881 |
| | | | | | 13183–14085 |
| | | | | | 14097–14550 |
| | | | | | 14578–14689 |
| | | | | | 14743–15423 |
| | | | | | 15487–15904 |
| | | | | | 18296–18502 |
| | | | | | 18622–18911 |
| | | | | | 19246–19481 |
| HTGGO35 | 3215 | 954651 | AC012557 | 13296 | 1–262 |
| HTHBH29 | 3216 | 882405 | AL157695 | 13297 | 1–1046 |
| HTHBH29 | 3216 | 882405 | AL138965 | 13298 | 1–1046 |
| HTHBH29 | 3216 | 882405 | AL157695 | 13299 | 1–213 |
| HTHBH29 | 3216 | 882405 | AL138965 | 13300 | 1–592 |
| HTHBH29 | 3216 | 882405 | AL138965 | 13301 | 1–213 |
| HTHC079 | 3222 | 889742 | AC023232 | 13302 | 1–953 |
| HTLEW81 | 3247 | 815687 | AC004844 | 13303 | 1–134 |
| | | | | | 4693–5166 |
| | | | | | 5850–7262 |
| HTLIO20 | 3256 | 898249 | AC025178 | 13304 | 1–350 |
| | | | | | 361–684 |
| | | | | | 1087–1552 |
| HTLIO20 | 3256 | 898249 | AC022423 | 13305 | 1–2424 |
| | | | | | 2437–2913 |
| | | | | | 3913–4331 |
| | | | | | 4438–4734 |
| | | | | | 6062–6179 |
| | | | | | 8894–9130 |
| | | | | | 9632–9706 |
| | | | | | 10432–10781 |
| | | | | | 10792–11114 |
| | | | | | 11517–11984 |
| | | | | | 12170–12569 |
| | | | | | 14349–14709 |
| | | | | | 20546–20612 |
| | | | | | 21121–24268 |
| HTLIO20 | 3256 | 898249 | AC022444 | 13306 | 1–350 |
| | | | | | 361–683 |
| | | | | | 1086–1553 |
| HTLIO20 | 3256 | 898249 | AC008803 | 13307 | 1–349 |
| | | | | | 360–682 |
| | | | | | 1085–1552 |
| HTLIO20 | 3256 | 898249 | AC025178 | 13308 | 1–401 |
| HTLIO20 | 3256 | 898249 | AC022423 | 13309 | 1–590 |
| HTLIO20 | 3256 | 898249 | AC022423 | 13310 | 1–96 |
| | | | | | 113–270 |
| HTLIO20 | 3256 | 898249 | AC022444 | 13311 | 1–547 |
| HTLIO20 | 3256 | 898249 | AC022444 | 13312 | 1–400 |
| HTLIO20 | 3256 | 898249 | AC008803 | 13313 | 1–400 |
| HTLJF15 | 3260 | 917073 | AC005764 | 13314 | 1–1435 |
| HTOHB55 | 3277 | 902034 | AC008131 | 13315 | 1–1066 |
| | | | | | 2015–2470 |
| | | | | | 2485–2807 |
| | | | | | 3006–3747 |
| | | | | | 3946–4403 |
| | | | | | 4432–7591 |
| HTOHB55 | 3277 | 902034 | AC016525 | 13316 | 1–1065 |
| | | | | | 2013–2467 |
| | | | | | 2482–2804 |
| | | | | | 3003–3744 |
| | | | | | 3943–4400 |
| | | | | | 4429–7557 |
| HTOHB55 | 3277 | 902034 | AC008131 | 13317 | 1–154 |
| HTOHB55 | 3277 | 902034 | AC008131 | 13318 | 1–512 |
| HTOHB55 | 3277 | 902034 | AC016525 | 13319 | 1–154 |
| HTPAB57 | 3287 | 926712 | AC067853 | 13320 | 1–1963 |
| HTPAB57 | 3287 | 926712 | AC012305 | 13321 | 1–3753 |
| HTPAB57 | 3287 | 926712 | AC067853 | 13322 | 1–481 |
| HTTBM40 | 3309 | 1034648 | AC016992 | 13323 | 1–106 |
| | | | | | 1835–4833 |
| HTTDF41 | 3313 | 827309 | AC004643 | 13324 | 1–1334 |
| HTTDF41 | 3313 | 827309 | AC044819 | 13325 | 1–1363 |
| HTTDF41 | 3313 | 827309 | AL353807 | 13326 | 1–1363 |
| HTTDF41 | 3313 | 827309 | AC004643 | 13327 | 1–153 |
| | | | | | 2251–2551 |
| HTTDF41 | 3313 | 827309 | AC004643 | 13328 | 1–608 |
| HTTDF41 | 3313 | 827309 | AC044819 | 13329 | 1–448 |
| HTTDF41 | 3313 | 827309 | AL353807 | 13330 | 1–448 |
| HTTIJ31 | 3321 | 1165265 | AC009516 | 13331 | 1–547 |
| | | | | | 706–1777 |
| HTTIJ31 | 3321 | 1165265 | AC009516 | 13332 | 1–139 |
| HTTIJ31 | 3321 | 1165265 | AC009516 | 13333 | 1–472 |

TABLE 1C-continued

| cDNA Clone ID | SEQ ID NO: X | CONTIG ID: | BAC ID: A | SEQ ID NO: B | EXON From-To |
|---|---|---|---|---|---|
| HTTJK27 | 3322 | 1169211 | AC006512 | 13334 | 1096–2291 |
| | | | | | 1–247 |
| | | | | | 2812–2918 |
| | | | | | 3488–3953 |
| | | | | | 3964–4527 |
| | | | | | 4683–5151 |
| | | | | | 5330–9121 |
| | | | | | 9884–10335 |
| | | | | | 10748–10781 |
| | | | | | 10960–11055 |
| | | | | | 11323–12111 |
| | | | | | 12127–12791 |
| | | | | | 12911–13262 |
| | | | | | 13266–13791 |
| | | | | | 14696–14866 |
| | | | | | 15107–15207 |
| | | | | | 16551–16955 |
| | | | | | 17174–17614 |
| | | | | | 18504–18749 |
| | | | | | 19392–19660 |
| | | | | | 19720–20075 |
| | | | | | 20785–21233 |
| | | | | | 21290–21733 |
| | | | | | 23618–23649 |
| | | | | | 23982–24188 |
| | | | | | 24481–24573 |
| | | | | | 24741–25003 |
| | | | | | 26591–26705 |
| | | | | | 26738–27249 |
| | | | | | 28479–28858 |
| | | | | | 29065–31669 |
| | | | | | 31926–32887 |
| | | | | | 33667–34293 |
| | | | | | 35229–35682 |
| | | | | | 38114–38771 |
| HTTJK27 | 3322 | 1169211 | AC021777 | 13335 | 1–199 |
| | | | | | 272–3219 |
| HTTJK27 | 3322 | 1169211 | AC006512 | 13336 | 1–818 |
| | | | | | 963–1440 |
| | | | | | 1469–1958 |
| | | | | | 2220–3076 |
| | | | | | 3455–3663 |
| | | | | | 3931–4285 |
| | | | | | 4549–4632 |
| | | | | | 4696–5069 |
| | | | | | 5245–5337 |
| | | | | | 5461–5775 |
| HTTJK27 | 3322 | 1169211 | AC006512 | 13337 | 1–738 |
| HTTJK27 | 3322 | 1169211 | AC021777 | 13338 | 1–89 |
| HTTJK27 | 3322 | 1169211 | AC021777 | 13339 | 1–163 |
| | | | | | 1462–1554 |
| | | | | | 4174–4414 |
| | | | | | 5604–8438 |
| HTWAF58 | 3324 | 411798 | AL109916 | 13340 | 1–255 |
| HTWAF58 | 3324 | 411798 | AC073580 | 13341 | 1–255 |
| HTWAF58 | 3324 | 411798 | AL109916 | 13342 | 1–306 |
| HTWAF58 | 3324 | 411798 | AC073580 | 13343 | 1–306 |
| HTXBN56 | 3341 | 919917 | AL031864 | 13344 | 1–583 |
| | | | | | 2198–2960 |
| | | | | | 4339–4540 |
| | | | | | 5221–5778 |
| | | | | | 6192–6390 |
| | | | | | 8665–9385 |
| | | | | | 10475–10695 |
| | | | | | 11047–11388 |
| | | | | | 12854–12989 |
| | | | | | 13948–14282 |
| | | | | | 14296–14731 |
| | | | | | 14765–16176 |
| HTXBN56 | 3341 | 919917 | AL031864 | 13345 | 1–403 |
| HTXKV29 | 3370 | 1180270 | AL139289 | 13346 | 1–745 |
| | | | | | 925–1068 |
| | | | | | 1145–1251 |
| | | | | | 1258–2123 |
| | | | | | 2170–2229 |
| | | | | | 2763–3097 |
| | | | | | 3126–3330 |
| | | | | | 4090–4628 |
| HTXKV29 | 3370 | 1180270 | AL139289 | 13347 | 1–589 |
| | | | | | 677–839 |
| | | | | | 914–1014 |
| | | | | | 1159–1288 |
| | | | | | 1384–1595 |
| | | | | | 1685–1784 |
| | | | | | 1919–2504 |
| | | | | | 3381–3505 |
| | | | | | 4134–4447 |
| HTXKV29 | 3370 | 1180270 | AL139289 | 13348 | 1–166 |
| HTXLH48 | 3373 | 1120164 | AC010757 | 13349 | 1–1082 |
| HTXLH48 | 3373 | 1120164 | AC016771 | 13350 | 1–1065 |
| | | | | | 3619–3714 |
| | | | | | 4148–4747 |
| | | | | | 6131–8022 |
| HTXLH48 | 3373 | 1120164 | AC010757 | 13351 | 1–894 |
| HTXLH48 | 3373 | 1120164 | AC016771 | 13352 | 1–894 |
| HTXLH48 | 3373 | 1120164 | AC016771 | 13353 | 1–519 |
| HTXNL31 | 3375 | 1095105 | AP000481 | 13354 | 1–2010 |
| HTXNL31 | 3375 | 1095105 | AP000671 | 13355 | 1–2007 |
| HTXNL31 | 3375 | 1095105 | AC019220 | 13356 | 1–2005 |
| HTXNL31 | 3375 | 1095105 | AP001385 | 13357 | 1–2005 |
| HTXNL31 | 3375 | 1095105 | AP000481 | 13358 | 1–323 |
| HTXNL31 | 3375 | 1095105 | AP000671 | 13359 | 1–987 |
| | | | | | 1154–2654 |
| HTXNL31 | 3375 | 1095105 | AC019220 | 13360 | 1–1107 |
| | | | | | 1275–2772 |
| HTXNL31 | 3375 | 1095105 | AC019220 | 13361 | 1–323 |
| HTXNL31 | 3375 | 1095105 | AP001385 | 13362 | 1–1470 |
| | | | | | 1637–3136 |
| HTXQM57 | 3378 | 1042384 | Z97197 | 13363 | 1–383 |
| | | | | | 545–896 |
| | | | | | 2998–3396 |
| | | | | | 3906–5039 |
| | | | | | 5917–6393 |
| | | | | | 6847–7124 |
| | | | | | 7674–7854 |
| | | | | | 7946–8005 |
| | | | | | 9168–14717 |
| HTXQM57 | 3378 | 1042384 | AC069234 | 13364 | 1–1134 |
| HTXQM57 | 3378 | 1042384 | AC069214 | 13365 | 1–1134 |
| HTXQM57 | 3378 | 1042384 | AC063942 | 13366 | 1–383 |
| | | | | | 545–896 |
| | | | | | 3000–3398 |
| | | | | | 3908–5041 |
| | | | | | 5919–6395 |
| | | | | | 6849–7126 |
| | | | | | 7676–7856 |
| | | | | | 7948–8007 |
| | | | | | 9170–14719 |
| HTXQM57 | 3378 | 1042384 | AC069234 | 13367 | 1–477 |
| HTXQM57 | 3378 | 1042384 | AC069234 | 13368 | 1–399 |
| HTXQM57 | 3378 | 1042384 | AC069214 | 13369 | 1–477 |
| HUCPD31 | 3382 | 1047438 | AC012363 | 13370 | 1–3333 |
| HUCPD31 | 3382 | 1047438 | AC012363 | 13371 | 1–181 |
| HUJCQ39 | 3393 | 1156360 | AC025916 | 13372 | 1–1156 |
| HUJCQ39 | 3393 | 1156360 | AC009658 | 13373 | 1–1155 |
| HUKCD10 | 3397 | 1008408 | AL133410 | 13374 | 1–974 |
| | | | | | 1094–1228 |
| | | | | | 1373–1558 |
| | | | | | 1670–1734 |
| | | | | | 1852–1989 |
| | | | | | 2084–2210 |
| | | | | | 2299–2515 |
| | | | | | 3026–3158 |
| | | | | | 3241–3431 |
| | | | | | 5374–5471 |
| | | | | | 5589–5689 |
| | | | | | 6124–6218 |
| | | | | | 6610–6732 |
| | | | | | 6826–6959 |
| | | | | | 7038–7233 |
| | | | | | 7300–7554 |
| | | | | | 7598–8146 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 8601–8724 |
| | | | | | 8801–8907 |
| | | | | | 9012–9171 |
| | | | | | 9249–9422 |
| | | | | | 9500–9606 |
| | | | | | 9820–9955 |
| | | | | | 10124–10308 |
| | | | | | 10395–10543 |
| | | | | | 10692–10948 |
| | | | | | 11391–11546 |
| | | | | | 12035–12388 |
| | | | | | 12642–12976 |
| | | | | | 13602–13738 |
| | | | | | 13847–13942 |
| | | | | | 14042–14128 |
| | | | | | 14301–14448 |
| | | | | | 14648–14846 |
| | | | | | 15059–15182 |
| | | | | | 15885–16098 |
| | | | | | 16251–16686 |
| | | | | | 17003–17139 |
| | | | | | 17290–17743 |
| | | | | | 17812–18592 |
| | | | | | 19442–19613 |
| | | | | | 20194–20496 |
| | | | | | 20669–21329 |
| HUKCD10 | 3397 | 1008408 | AL133410 | 13375 | 1–462 |
| HUSAQ05 | 3407 | 815691 | AP000654 | 13376 | 1–4150 |
| HUSIE23 | 3417 | 910142 | AL035668 | 13377 | 1–2038 |
| HUSIE23 | 3417 | 910142 | AC026511 | 13378 | 1–2038 |
| HUSZS75 | 3429 | 1352413 | AC009077 | 13379 | 1–2256 |
| HUSZS75 | 3429 | 1352413 | AC009077 | 13380 | 1–394 |
| HUVFB80 | 3435 | 1040863 | AL133448 | 13381 | 1–54 |
| | | | | | 67–218 |
| | | | | | 294–361 |
| | | | | | 1214–1554 |
| | | | | | 1775–2277 |
| | | | | | 2577–2901 |
| | | | | | 3374–3590 |
| | | | | | 4272–5144 |
| HUVFB80 | 3435 | 1040863 | AL135998 | 13382 | 1–54 |
| | | | | | 67–218 |
| | | | | | 294–361 |
| | | | | | 1214–1554 |
| | | | | | 1775–2277 |
| | | | | | 2466–2731 |
| | | | | | 2856–2987 |
| | | | | | 3374–3590 |
| | | | | | 4279–5144 |
| HUVFB80 | 3435 | 1040863 | AL133448 | 13383 | 1–187 |
| HUVFB80 | 3435 | 1040863 | AL133448 | 13384 | 1–349 |
| | | | | | 4045–4227 |
| | | | | | 4914–5062 |
| | | | | | 5333–5457 |
| | | | | | 5821–6140 |
| | | | | | 6672–6839 |
| | | | | | 7131–7293 |
| | | | | | 7787–7939 |
| | | | | | 8037–8202 |
| | | | | | 8670–8788 |
| | | | | | 9125–11183 |
| HUVFB80 | 3435 | 1040863 | AL135998 | 13385 | 1–349 |
| | | | | | 3396–3482 |
| | | | | | 4035–4228 |
| | | | | | 4915–5063 |
| | | | | | 5337–5458 |
| | | | | | 5833–6000 |
| HUVFB80 | 3435 | 1040863 | AL135998 | 13386 | 1–187 |
| HUVFY29 | 3437 | 1352395 | AL136383 | 13387 | 1–484 |
| | | | | | 555–1344 |
| | | | | | 1350–1429 |
| | | | | | 1828–1947 |
| | | | | | 2460–2902 |
| | | | | | 3284–3331 |
| | | | | | 3386–3737 |
| | | | | | 3807–4948 |
| | | | | | 5059–5168 |
| | | | | | 5606–5703 |
| | | | | | 5869–6000 |
| | | | | | 8200–8552 |
| | | | | | 8881–8978 |
| | | | | | 9549–9927 |
| | | | | | 10458–10858 |
| | | | | | 11116–11692 |
| | | | | | 12186–12321 |
| | | | | | 12535–12724 |
| | | | | | 14311–14718 |
| | | | | | 15657–15809 |
| | | | | | 16754–16857 |
| | | | | | 17360–17466 |
| | | | | | 18768–19227 |
| | | | | | 19728–20348 |
| HUVFY29 | 3437 | 1352395 | AL136383 | 13388 | 1–133 |
| | | | | | 249–1033 |
| | | | | | 2166–2381 |
| | | | | | 2420–2568 |
| | | | | | 2935–3276 |
| | | | | | 3744–4447 |
| | | | | | 5929–6399 |
| | | | | | 7477–7611 |
| | | | | | 7949–9346 |
| | | | | | 9406–9532 |
| HVARW53 | 3440 | 1194812 | AC011298 | 13389 | 1–648 |
| | | | | | 1184–3022 |
| | | | | | 3943–4047 |
| | | | | | 5961–6504 |
| HVARW53 | 3440 | 1194812 | AC011298 | 13390 | 1–397 |
| HVVAM64 | 3441 | 1186275 | AC023786 | 13391 | 1–1165 |
| | | | | | 1586–1624 |
| | | | | | 1808–2761 |
| | | | | | 3231–3329 |
| | | | | | 3534–7009 |
| | | | | | 7036–8261 |
| HVVAM64 | 3441 | 1186275 | AC023786 | 13392 | 1–280 |
| HVVAM64 | 3441 | 1186275 | AC023786 | 13393 | 1–802 |
| HWAAW33 | 3443 | 1138604 | AL031963 | 13394 | 1–760 |
| | | | | | 1833–2119 |
| | | | | | 2151–2275 |
| | | | | | 5038–5162 |
| | | | | | 5512–6132 |
| | | | | | 7525–10309 |
| HWAFT87 | 3451 | 1001609 | AC026367 | 13395 | 1–1227 |
| HWAFT87 | 3451 | 1001609 | AC053518 | 13396 | 1–1241 |
| HWAFT87 | 3451 | 1001609 | AC048339 | 13397 | 1–1241 |
| HWAFT87 | 3451 | 1001609 | AC026367 | 13398 | 1–285 |
| HWAFT87 | 3451 | 1001609 | AC053518 | 13399 | 1–483 |
| HWAFT87 | 3451 | 1001609 | AC053518 | 13400 | 1–278 |
| HWAFT87 | 3451 | 1001609 | AC048339 | 13401 | 1–278 |
| HWAFT87 | 3451 | 1001609 | AC048339 | 13402 | 1–484 |
| HWBAD01 | 3454 | 824346 | AC078864 | 13403 | 1–2647 |
| | | | | | 2808–2892 |
| HWBAD01 | 3454 | 824346 | AC025259 | 13404 | 1–2650 |
| | | | | | 2811–2897 |
| HWBAD01 | 3454 | 824346 | AC019244 | 13405 | 1–1490 |
| | | | | | 1553–2021 |
| | | | | | 8170–8277 |
| | | | | | 8931–9047 |
| | | | | | 14413–14894 |
| | | | | | 17508–17642 |
| | | | | | 20758–23407 |
| | | | | | 23568–23654 |
| | | | | | 24507–24864 |
| | | | | | 25932–26463 |
| | | | | | 27845–28757 |
| | | | | | 28863–29539 |
| | | | | | 30432–30750 |
| | | | | | 31597–32100 |
| HWBAO29 | 3455 | 948565 | AL118558 | 13406 | 1–141 |
| | | | | | 490–670 |
| | | | | | 807–921 |
| | | | | | 1154–1446 |
| | | | | | 1738–1883 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 3053–3092 |
| | | | | | 4741–4965 |
| | | | | | 5169–5618 |
| | | | | | 5807–5965 |
| | | | | | 6107–6218 |
| | | | | | 6388–6675 |
| | | | | | 6773–6881 |
| | | | | | 6962–7173 |
| | | | | | 7351–7502 |
| | | | | | 8174–8218 |
| | | | | | 8358–8520 |
| | | | | | 8609–8786 |
| | | | | | 9775–10096 |
| | | | | | 10114–10330 |
| | | | | | 10335–10504 |
| | | | | | 10579–10770 |
| | | | | | 10862–11054 |
| | | | | | 11706–11819 |
| | | | | | 14037–14152 |
| | | | | | 15304–15606 |
| | | | | | 15657–15901 |
| | | | | | 16091–16272 |
| | | | | | 16346–16888 |
| | | | | | 17093–17565 |
| | | | | | 17688–17935 |
| | | | | | 18130–18290 |
| | | | | | 18788–19094 |
| | | | | | 19456–19894 |
| | | | | | 20916–21144 |
| | | | | | 21668–22301 |
| | | | | | 22494–22815 |
| | | | | | 22899–23108 |
| | | | | | 23197–23320 |
| | | | | | 23727–23931 |
| | | | | | 24260–24436 |
| | | | | | 24767–24989 |
| | | | | | 25705–25871 |
| | | | | | 28563–28693 |
| | | | | | 29711–30146 |
| | | | | | 30509–30797 |
| | | | | | 31282–31922 |
| | | | | | 32381–32523 |
| | | | | | 32985–33100 |
| | | | | | 33195–33356 |
| | | | | | 33431–33644 |
| | | | | | 33740–33970 |
| | | | | | 34399–34746 |
| | | | | | 35277–35567 |
| | | | | | 35633–35750 |
| | | | | | 35974–36101 |
| | | | | | 36124–36476 |
| | | | | | 38082–38675 |
| | | | | | 38876–39003 |
| | | | | | 39077–40008 |
| | | | | | 40121–40398 |
| | | | | | 40559–40656 |
| | | | | | 42254–42653 |
| | | | | | 42846–43221 |
| | | | | | 44186–44664 |
| | | | | | 44815–45071 |
| | | | | | 45223–45367 |
| | | | | | 45443–45547 |
| | | | | | 46049–46224 |
| | | | | | 46410–46487 |
| | | | | | 47384–47550 |
| | | | | | 47824–47940 |
| | | | | | 48043–48107 |
| | | | | | 48194–48933 |
| | | | | | 49144–49456 |
| | | | | | 49547–51652 |
| | | | | | 51710–52007 |
| | | | | | 52430–52637 |
| | | | | | 53321–53569 |
| | | | | | 53630–53843 |
| | | | | | 54318–54485 |
| | | | | | 54667–55098 |
| | | | | | 55244–55396 |
| | | | | | 55495–55698 |
| | | | | | 55870–56026 |
| | | | | | 56239–56743 |
| HWBAO29 | 3455 | 948565 | AL133223 | 13407 | 1–107 |
| | | | | | 293–370 |
| | | | | | 1267–1433 |
| | | | | | 1707–1823 |
| | | | | | 1926–1990 |
| | | | | | 2077–2816 |
| | | | | | 3027–3339 |
| | | | | | 3431–5015 |
| | | | | | 5593–5883 |
| | | | | | 7509–7722 |
| | | | | | 8197–8364 |
| | | | | | 8546–8977 |
| | | | | | 9123–9275 |
| | | | | | 9374–9577 |
| | | | | | 9749–9905 |
| | | | | | 10118–10622 |
| HWBAO29 | 3455 | 948565 | AL118558 | 13408 | 1–194 |
| HWBAO29 | 3455 | 948565 | AL118558 | 13409 | 1–439 |
| HWBAO29 | 3455 | 948565 | AL133223 | 13410 | 1–558 |
| HWBCV72 | 3462 | 1352366 | AC018851 | 13411 | 1–2951 |
| HWBCV72 | 3462 | 1352366 | AC018630 | 13412 | 1–234 |
| HWBCV72 | 3462 | 1352366 | AC018630 | 13413 | 1–235 |
| HWBCV72 | 3462 | 1352366 | AC018630 | 13414 | 1–235 |
| HWBCV72 | 3462 | 1352366 | AC018630 | 13415 | 1–606 |
| HWBCV72 | 3462 | 1352366 | AC018630 | 13416 | 1–622 |
| HWBDM62 | 3465 | 906779 | AP000172 | 13417 | 1–3370 |
| HWBDM62 | 3465 | 906779 | AP000125 | 13418 | 1–3370 |
| HWBDM62 | 3465 | 906779 | AP000057 | 13419 | 1–3370 |
| HWBDM62 | 3465 | 906779 | AP000172 | 13420 | 1–647 |
| | | | | | 660–774 |
| HWBDM62 | 3465 | 906779 | AP000172 | 13421 | 1–227 |
| HWBDM62 | 3465 | 906779 | AP000125 | 13422 | 1–647 |
| | | | | | 660–774 |
| HWBDM62 | 3465 | 906779 | AP000125 | 13423 | 1–227 |
| HWBDM62 | 3465 | 906779 | AP000057 | 13424 | 1–647 |
| | | | | | 660–774 |
| HWBDM62 | 3465 | 906779 | AP000057 | 13425 | 1–227 |
| HWDAD17 | 3471 | 1352388 | AC027607 | 13426 | 1–1557 |
| HWDAD17 | 3471 | 1352388 | AC036185 | 13427 | 1–1568 |
| HWDAD17 | 3471 | 1352388 | AC027607 | 13428 | 1–528 |
| HWDAD17 | 3471 | 1352388 | AC027607 | 13429 | 1–466 |
| HWDAD17 | 3471 | 1352388 | AC036185 | 13430 | 1–528 |
| HWEAC77 | 3474 | 984653 | AC004578 | 13431 | 1–2636 |
| HWEAC77 | 3474 | 984653 | AC006235 | 13432 | 1–2643 |
| HWEAD64 | 3475 | 1028594 | Z84466 | 13433 | 1–3869 |
| HWHHD11 | 3477 | 908150 | AC068145 | 13434 | 1–66 |
| | | | | | 380–866 |
| | | | | | 976–1123 |
| | | | | | 1584–1688 |
| | | | | | 1831–1986 |
| | | | | | 2208–2683 |
| | | | | | 2849–3388 |
| | | | | | 3547–3669 |
| | | | | | 3746–3876 |
| | | | | | 4241–4332 |
| | | | | | 5304–6566 |
| | | | | | 6642–6772 |
| | | | | | 6799–7251 |
| HWHHD11 | 3477 | 908150 | AC021196 | 13435 | 1–139 |
| | | | | | 600–703 |
| | | | | | 847–1002 |
| | | | | | 1224–1698 |
| | | | | | 2068–2307 |
| | | | | | 2555–2677 |
| | | | | | 2753–2883 |
| | | | | | 3247–3338 |
| | | | | | 4310–5549 |
| | | | | | 5643–5773 |
| | | | | | 5800–6251 |
| HWHHD11 | 3477 | 908150 | AC068145 | 13436 | 1–345 |
| HWHHD11 | 3477 | 908150 | AC021196 | 13437 | 1–487 |
| HWHHD11 | 3477 | 908150 | AC021196 | 13438 | 1–345 |

TABLE 1C-continued

| cDNA Clone ID | SEQ ID NO: X | CONTIG ID: | BAC ID: A | SEQ ID NO: B | EXON From-To |
|---|---|---|---|---|---|
| HWHIH10 | 3478 | 949404 | AC004036 | 13439 | 1–97 |
| | | | | | 1611–1894 |
| | | | | | 3686–3708 |
| | | | | | 4316–4493 |
| | | | | | 5873–6147 |
| | | | | | 6512–7131 |
| | | | | | 7396–7793 |
| HWHIH10 | 3478 | 949404 | AC004036 | 13440 | 1–297 |
| HWHIM26 | 3479 | 1120279 | AP000879 | 13441 | 1–1048 |
| HWHKR51 | 3482 | 1111166 | AC022488 | 13442 | 1–99 |
| | | | | | 435–525 |
| | | | | | 680–793 |
| | | | | | 918–1021 |
| | | | | | 1162–1255 |
| | | | | | 1415–1567 |
| | | | | | 1983–2557 |
| | | | | | 2891–3364 |
| | | | | | 4092–4205 |
| | | | | | 4310–4450 |
| | | | | | 4858–4915 |
| | | | | | 5021–5237 |
| | | | | | 5851–6785 |
| | | | | | 7133–7163 |
| | | | | | 9614–9843 |
| | | | | | 10020–10125 |
| | | | | | 10452–10596 |
| | | | | | 10692–10923 |
| HWHKR51 | 3482 | 1111166 | AC022488 | 13443 | 1–353 |
| HWHKR51 | 3482 | 1111166 | AC022488 | 13444 | 1–228 |
| | | | | | 595–1111 |
| | | | | | 1184–1700 |
| | | | | | 1702–1847 |
| HWLFE89 | 3494 | 919921 | AC027131 | 13445 | 1–116 |
| | | | | | 524–943 |
| | | | | | 1370–1474 |
| | | | | | 1906–2112 |
| | | | | | 2217–2357 |
| | | | | | 2474–2690 |
| | | | | | 3080–3238 |
| | | | | | 3351–3453 |
| | | | | | 4458–4579 |
| | | | | | 4958–5248 |
| | | | | | 5463–5604 |
| | | | | | 8069–8153 |
| | | | | | 8418–8498 |
| | | | | | 9909–10057 |
| | | | | | 11092–11243 |
| | | | | | 11406–11483 |
| | | | | | 11591–13893 |
| HWLFE89 | 3494 | 919921 | AC027131 | 13446 | 1–125 |
| HWLFQ64 | 3496 | 1035384 | AP001381 | 13447 | 1–807 |
| HWLFQ64 | 3496 | 1035384 | AC021927 | 13448 | 1–453 |
| | | | | | 1098–1648 |
| | | | | | 2552–3358 |
| | | | | | 4520–4630 |
| | | | | | 5307–5616 |
| HWLFQ64 | 3496 | 1035384 | AC015956 | 13449 | 1–303 |
| | | | | | 1785–1867 |
| | | | | | 3858–4318 |
| | | | | | 4963–5513 |
| | | | | | 6417–7223 |
| | | | | | 8385–8495 |
| | | | | | 9172–9523 |
| | | | | | 11606–11767 |
| | | | | | 12730–12864 |
| | | | | | 16121–16417 |
| | | | | | 17842–17955 |
| | | | | | 20344–20469 |
| | | | | | 20714–20839 |
| | | | | | 22618–25128 |
| HWLFQ64 | 3496 | 1035384 | AP001381 | 13450 | 1–111 |
| HWLFQ64 | 3496 | 1035384 | AP001381 | 13451 | 1–551 |
| HWLFQ64 | 3496 | 1035384 | AC015956 | 13452 | 1–395 |
| HWLHM66 | 3500 | 1352384 | AF205589 | 13453 | 1–534 |
| | | | | | 825–1175 |
| | | | | | 1334–1467 |
| | | | | | 1544–1679 |
| | | | | | 1846–2021 |
| | | | | | 2311–2484 |
| | | | | | 2562–2697 |
| | | | | | 2814–3007 |
| | | | | | 3396–3680 |
| | | | | | 4185–4780 |
| | | | | | 6229–6641 |
| | | | | | 7361–7469 |
| HWLHM66 | 3500 | 1352384 | AC022505 | 13454 | 1–534 |
| | | | | | 825–1175 |
| | | | | | 1334–1467 |
| | | | | | 1544–1681 |
| | | | | | 1848–2022 |
| | | | | | 2312–2485 |
| | | | | | 2560–2698 |
| | | | | | 2815–3008 |
| | | | | | 3397–3681 |
| | | | | | 4186–4781 |
| | | | | | 6231–6643 |
| | | | | | 7363–7471 |
| HWLHM66 | 3500 | 1352384 | AF205589 | 13455 | 1–443 |
| HWLHM66 | 3500 | 1352384 | AF205589 | 13456 | 1–380 |
| HWLHM66 | 3500 | 1352384 | AC022505 | 13457 | 1–451 |
| | | | | | 1203–1384 |
| | | | | | 1412–1454 |
| HWLHM66 | 3500 | 1352384 | AC022505 | 13458 | 1–540 |
| HWLJE21 | 3502 | 1352408 | AC073646 | 13459 | 1–305 |
| | | | | | 385–936 |
| | | | | | 1137–1774 |
| | | | | | 2212–2624 |
| | | | | | 3336–4162 |
| | | | | | 4293–4774 |
| | | | | | 4819–6169 |
| | | | | | 6371–6446 |
| | | | | | 7330–7429 |
| | | | | | 7544–7727 |
| | | | | | 8089–8199 |
| | | | | | 8356–8644 |
| | | | | | 9239–9350 |
| | | | | | 10305–10377 |
| | | | | | 11526–12187 |
| | | | | | 12379–12484 |
| | | | | | 12857–12991 |
| HWLJE21 | 3502 | 1352408 | AC073646 | 13460 | 1–298 |
| HWLJX42 | 3504 | 931868 | AL157400 | 13461 | 1–255 |
| | | | | | 1366–1681 |
| | | | | | 1964–2444 |
| | | | | | 5518–5694 |
| | | | | | 6187–6308 |
| | | | | | 7011–7234 |
| | | | | | 10728–10856 |
| | | | | | 12373–12458 |
| | | | | | 15040–16523 |
| HWLJX42 | 3504 | 931868 | AL157400 | 13462 | 1–389 |
| | | | | | 1476–1744 |
| HWMKQ25 | 3510 | 1352419 | AC016331 | 13463 | 1–804 |
| | | | | | 818–1115 |
| | | | | | 1556–1630 |
| | | | | | 1729–3233 |
| | | | | | 3279–3345 |
| | | | | | 3482–3691 |
| | | | | | 3806–5459 |
| | | | | | 6306–6379 |
| | | | | | 7141–7320 |
| | | | | | 7578–7640 |
| HWMKQ25 | 3510 | 1352419 | AC016331 | 13464 | 1–124 |
| HWTBF59 | 3516 | 740670 | AF205589 | 13465 | 1–59 |
| | | | | | 134–367 |
| | | | | | 820–1643 |
| | | | | | 2081–4964 |
| HWTBF59 | 3516 | 740670 | AC022505 | 13466 | 1–59 |
| | | | | | 134–367 |
| | | | | | 820–1643 |
| | | | | | 2081–4964 |
| HWTBF59 | 3516 | 740670 | AF205589 | 13467 | 1–346 |

TABLE 1C-continued

| cDNA Clone ID | SEQ ID NO: X | CONTIG ID: | BAC ID: A | SEQ ID NO: B | EXON From-To |
|---|---|---|---|---|---|
| | | | | | 556–815 |
| | | | | | 839–924 |
| | | | | | 1480–1555 |
| | | | | | 2093–2226 |
| | | | | | 2710–3130 |
| | | | | | 3294–4014 |
| HWTBF59 | 3516 | 740670 | AC022505 | 13468 | 1–346 |
| | | | | | 556–814 |
| | | | | | 838–923 |
| | | | | | 1479–1554 |
| | | | | | 2092–2225 |
| | | | | | 2709–3129 |
| | | | | | 3293–4013 |

Tables 1D and 1E: The polynucleotides or polypeptides, or agonists or antagonists of the present invention can be used in assays to test for one or more biological activities. If these polynucleotides and polypeptides do exhibit activity in a particular assay, it is likely that these molecules may be involved in the diseases associated with the biological activity. Thus, the polynucleotides or polypeptides, or agonists or antagonists could be used to treat the associated disease.

The present invention encompasses methods of detecting, preventing, diagnosing, prognosticating, treating, and/or ameliorating a disease or disorder. In preferred embodiments, the present invention encompasses a method of treating a disease or disorder listed in the "Preferred Indications" columns of Table 1D and Table 1E; comprising administering to a patient (in which such treatment, prevention, or amelioration is desired) a protein, nucleic acid, or antibody of the invention (or fragment or variant thereof) in an amount effective to treat, prevent, diagnose, or ameliorate the disease or disorder. The first and second columns of Table 1D show the "Gene No." and "cDNA Clone ID No.", respectively, indicating certain nucleic acids and proteins (or antibodies against the same) of the invention (including polynucleotide, polypeptide, and antibody fragments or variants thereof) that may be used in preventing, treating, diagnosing, or ameliorating the disease(s) or disorder(s) indicated in the corresponding row in Column 3 of Table 1D.

In another embodiment, the present invention also encompasses methods of preventing, treating, diagnosing, or ameliorating a disease or disorder listed in the "Preferred Indications" column of Table 1D and Table 1E; comprising administering to a patient combinations of the proteins, nucleic acids, or antibodies of the invention (or fragments or variants thereof), sharing similar indications as shown in the corresponding rows in Column 3 of Table 1D.

The "Preferred Indications" columns of Table 1D and Table 1E describe diseases, disorders, and/or conditions that may be treated, prevented, diagnosed, or ameliorated by a protein, nucleic acid, or antibody of the invention (or fragment or variant thereof).

The recitation of "Cancer" in the "Preferred Indications" columns indicates that the corresponding nucleic acid and protein, or antibody against the same, of the invention (or fragment or variant thereof) may be used for example, to diagnose, treat, prevent, and/or ameliorate diseases and/or disorders relating to neoplastic diseases (e.g., leukemias, cancers, and/or as described below under "Hyperproliferative Disorders").

In specific embodiments, a protein, nucleic acid, or antibody of the invention (or fragment or variant thereof) having a "Cancer" recitation in the "Preferred Indication" column of Table 1D may be used for example, to diagnose, treat, prevent, and/or ameliorate a neoplasm located in a tissue selected from the group consisting of: colon, abdomen, bone, breast, digestive system, liver, pancreas, prostate, peritoneum, lung, blood (e.g., leukemia), endocrine glands (adrenal, parathyroid, pituitary, testicles, ovary, thymus, thyroid), uterus, eye, head and neck, nervous (central and peripheral), lymphatic system, pelvic, skin, soft tissue, spleen, thoracic, and urogenital.

In specific embodiments, a protein, nucleic acid, or antibody of the invention (or fragment or variant thereof) having a "Cancer" recitation in the "Preferred Indication" column of Table 1D, may be used for example, to diagnose, treat, prevent, and/or ameliorate a pre-neoplastic condition, selected from the group consisting of: hyperplasia (e.g., endometrial hyperplasia and/or as described in the section entitled "Hyperproliferative Disorders"), metaplasia (e.g., connective tissue metaplasia, atypical metaplasia, and/or as described in the section entitled "Hyperproliferative Disorders"), and/or dysplasia (e.g., cervical dysplasia, and bronchopulmonary dysplasia).

In another specific embodiment, a protein, nucleic acid, or antibody of the invention (or fragment or variant thereof) having a "Cancer" recitation in the "Preferred Indication" column of Table 1D, may be used for example, to diagnose, treat, prevent, and/or ameliorate a benign dysproliferative disorder selected from the group consisting of: benign tumors, fibrocystic conditions, tissue hypertrophy, and/or as described in the section entitled "Hyperproliferative Disorders".

The recitation of "Immune/Hematopoietic" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

In specific embodiments, a protein, nucleic acid, or antibody of the invention (or fragment or variant thereof) having the "Immune/Hematopoietic" recitation in the "Preferred Indication" column of Table 1D, may be used for example, to diagnose, treat, prevent, and/or ameliorate a disease or disorder selected from the group consisting of: anemia, pancytopenia, leukopenia, thrombocytopenia, leukemias, Hodgkin's disease, non-Hodgkin's lymphoma, acute lymphocytic anemia (ALL), plasmacytomas, multiple myeloma, Burkitt's lymphoma, arthritis, asthma, AIDS, autoimmune disease, rheumatoid arthritis, granulomatous disease, immune deficiency, inflammatory bowel disease, sepsis, neutropenia, neutrophilia, psoriasis, immune reactions to transplanted organs and tissues, systemic lupus erythematosis, hemophilia, hypercoagulation, diabetes mellitus, endocarditis, meningitis, Lyme Disease, and allergies.

The recitation of "Reproductive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the reproductive system (e.g., as described below under "Reproductive System Disorders").

In specific embodiments, a protein, nucleic acid, or antibody of the invention (or fragment or variant thereof) having a "Reproductive" recitation in the "Preferred Indication" column of Table 1D, may be used for example, to diagnose, treat, prevent, and/or ameliorate a disease or disorder selected from the group consisting of: cryptorchism, prostatitis, inguinal hernia, varicocele, leydig cell tumors, verrucous carcinoma, prostatitis, malacoplakia, Peyronie's disease, penile carcinoma, squamous cell hyperplasia, dysmenorrhea, ovarian adenocarcinoma, Turner's syndrome, mucopurulent cervicitis, Sertoli-leydig tumors, ovarian cancer, uterine cancer, pelvic inflammatory disease, testicular cancer, prostate cancer, Klinefelter's syndrome, Young's syndrome, premature ejaculation, diabetes mellitus, cystic fibrosis, Kartagener's syndrome, testicular atrophy, testicular feminization, anorchia, ectopic testis, epididymitis, orchitis, gonorrhea, syphilis, testicular torsion, vasitis nodosa, germ cell tumors, stromal tumors, dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding, cervicitis, chronic cervicitis, mucopurulent cervicitis, cervical dysplasia, cervical polyps, Nabothian cysts, cervical erosion, cervical incompetence, cervical neoplasms, pseudohermaphroditism, and premenstrual syndrome.

The recitation of "Musculoskeletal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the immune system (e.g., as described below under "Immune Activity").

In specific embodiments, a protein, nucleic acid, or antibody of the invention (or fragment or variant thereof) having a "Musculoskeletal" recitation in the "Preferred Indication" column of Table 1D, may be used for example, to diagnose, treat, prevent, and/or ameliorate a disease or disorder selected from the group consisting of: bone cancers (e.g., osteochondromas, benign chondromas, chondroblastoma, chondromyxoid fibromas, osteoid osteomas, giant cell tumors, multiple myeloma, osteosarcomas), Paget's Disease, rheumatoid arthritis, systemic lupus erythematosus, osteomyelitis, Lyme Disease, gout, bursitis, tendonitis, osteoporosis, osteoarthritis, muscular dystrophy, mitochondrial myopathy, cachexia, and multiple sclerosis.

The recitation of "Cardiovascular" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the cardiovascular system (e.g., as described below under "Cardiovascular Disorders").

In specific embodiments, a protein, nucleic acid, or antibody of the invention (or fragment or variant thereof) having a "Cardiovascular" recitation in the "Preferred Indication" column of Table 1D, may be used for example, to diagnose, treat, prevent, and/or ameliorate a disease or disorder selected from the group consisting of: myxomas, fibromas, rhabdomyomas, cardiovascular abnormalities (e.g., congenital heart defects, cerebral arteriovenous malformations, septal defects), heart disease (e.g., heart failure, congestive heart disease, arrhythmia, tachycardia, fibrillation, pericardial Disease, endocarditis), cardiac arrest, heart valve disease (e.g., stenosis, regurgitation, prolapse), vascular disease (e.g., hypertension, coronary artery disease, angina, aneurysm, arteriosclerosis, peripheral vascular disease), hyponatremia, hypernatremia, hypokalemia, and hyperkalemia.

The recitation of "Mixed Fetal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders").

In specific embodiments, a protein, nucleic acid, or antibody of the invention (or fragment or variant thereof) having a "Mixed Fetal" recitation in the "Preferred Indication" column of Table 1D, may be used for example, to diagnose, treat, prevent, and/or ameliorate a disease or disorder selected from the group consisting of: spina bifida, hydranencephaly, neurofibromatosis, fetal alcohol syndrome, diabetes mellitus, PKU, Down's syndrome, Patau syndrome, Edwards syndrome, Turner syndrome, Apert syndrome, Carpenter syndrome, Conradi syndrome, Crouzon syndrome, cutis laxa, Cornelia de Lange syndrome, Ellis-van Creveld syndrome, Holt-Oram syndrome, Kartagener syndrome, Meckel-Gruber syndrome, Noonan syndrome, Pallister-Hall syndrome, Rubinstein-Taybi syndrome, Scimitar syndrome, Smith-Lemli-Opitz syndrome, thromocytopenia-absent radius (TAR) syndrome, Treacher Collins syndrome, Williams syndrome, Hirschsprung's disease, Meckel's diverticulum, polycystic kidney disease, Turner's syndrome, and gonadal dysgenesis, Klippel-Feil syndrome, Ostogenesis imperfecta, muscular dystrophy, Tay-Sachs disease, Wilm's tumor, neuroblastoma, and retinoblastoma.

The recitation of "Excretory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and renal disorders (e.g., as described below under "Renal Disorders").

In specific embodiments, a protein, nucleic acid, or antibody of the invention (or fragment or variant thereof) having a "Excretory" recitation in the "Preferred Indication" column of Table 1D, may be used for example, to diagnose, treat, prevent, and/or ameliorate a disease or disorder selected from the group consisting of: bladder cancer, prostate cancer, benign prostatic hyperplasia, bladder disorders (e.g., urinary incontinence, urinary retention, urinary obstruction, urinary tract Infections, interstitial cystitis, prostatitis, neurogenic bladder, hematuria), renal disorders (e.g., hydronephrosis, proteinuria, renal failure, pyelonephritis, urolithiasis, reflux nephropathy, and unilateral obstructive uropathy).

The recitation of "Neural/Sensory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the nervous system (e.g., as described below under "Neural Activity and Neurological Diseases").

In specific embodiments, a protein, nucleic acid, or antibody of the invention (or fragment or variant thereof) having a "Neural/Sensory" recitation in the "Preferred Indication" column of Table 1D, may be used for example, to diagnose, treat, prevent, and/or ameliorate a disease or disorder selected from the group consisting of: brain cancer (e.g., brain stem glioma, brain tumors, central nervous system (Primary) lymphoma, central nervous system lymphoma, cerebellar astrocytoma, and cerebral astrocytoma, neurodegenerative disorders (e.g., Alzheimer's Disease, Creutzfeldt-Jakob Disease, Parkinson's Disease, and Idiopathic Presenile Dementia), encephalomyelitis, cerebral malaria, meningitis, metabolic brain diseases (e.g., phenylketonuria and pyruvate carboxylase deficiency), cerebellar ataxia, ataxia telangiectasia, and AIDS Dementia Complex, schizophrenia, attention deficit disorder, hyperactive attention deficit disorder, autism, and obsessive compulsive disorders.

The recitation of "Respiratory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders").

In specific embodiments, a protein, nucleic acid, or antibody of the invention (or fragment or variant thereof) having a "Respiratory" recitation in the "Preferred Indication" column of Table 1D, may be used for example, to diagnose, treat, prevent, and/or ameliorate a disease or disorder selected from the group consisting of: cancers of the respiratory system such as larynx cancer, pharynx cancer, trachea cancer, epiglottis cancer, lung cancer, squamous cell carcinomas, small cell (oat cell) carcinomas, large cell carcinomas, and adenocarcinomas. Allergic reactions, cystic fibrosis, sarcoidosis, histiocytosis X, infiltrative lung diseases (e.g., pulmonary fibrosis and lymphoid interstitial pneumonia), obstructive airway diseases (e.g., asthma, emphysema, chronic or acute bronchitis), occupational lung diseases (e.g., silicosis and asbestosis), pneumonia, and pleurisy.

The recitation of "Endocrine" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders"), renal disorders (e.g., as described below under "Renal Disorders"), and disorders of the endocrine system (e.g., as described below under "Endocrine Disorders".

In specific embodiments, a protein, nucleic acid, or antibody of the invention (or fragment or variant thereof) having an "Endocrine" recitation in the "Preferred Indication" column of Table 1D, may be used for example, to diagnose, treat, prevent, and/or ameliorate a disease or disorder selected from the group consisting of: cancers of endocrine tissues and organs (e.g., cancers of the hypothalamus, pituitary gland, thyroid gland, parathyroid glands, pancreas, adrenal glands, ovaries, and testes), diabetes (e.g., diabetes insipidus, type I and type II diabetes mellitus), obesity, disorders related to pituitary glands (e.g., hyperpituitarism, hypopituitarism, and pituitary dwarfism), hypothyroidism, hyperthyroidism, goiter, reproductive disorders (e.g. male and female infertility), disorders related to adrenal glands (e.g., Addison's Disease, corticosteroid deficiency, and Cushing's Syndrome), kidney cancer (e.g., hypemephroma, transitional cell cancer, and Wilm's tumor), diabetic nephropathy, interstitial nephritis, polycystic kidney disease, glomerulonephritis (e.g., IgM mesangial proliferative glomerulonephritis and glomerulonephritis caused by autoimmune disorders; such as Goodpasture's syndrome), and nephrocalcinosis.

The recitation of "Digestive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the gastrointestinal system (e.g., as described below under "Gastrointestinal Disorders".

In specific embodiments, a protein, nucleic acid, or antibody of the invention (or fragment or variant thereof) having a "Digestive" recitation in the "Preferred Indication" column of Table 1D, may be used for example, to diagnose, treat, prevent, and/or ameliorate a disease or disorder selected from the group consisting of: ulcerative colitis, appendicitis, Crohn's disease, hepatitis, hepatic encephalopathy, portal hypertension, cholelithiasis, cancer of the digestive system (e.g., biliary tract cancer, stomach cancer, colon cancer, gastric cancer, pancreatic cancer, cancer of the bile duct, tumors of the colon (e.g., polyps or cancers), and cirrhosis), pancreatitis, ulcerative disease, pyloric stenosis, gastroenteritis, gastritis, gastric atropy, benign tumors of the duodenum, distension, irritable bowel syndrome, malabsorption, congenital disorders of the small intestine, bacterial and parasitic infection, megacolon, Hirschsprung's disease, aganglionic megacolon, acquired megacolon, colitis, anorectal disorders (e.g., anal fistulas, hemorrhoids), congenital disorders of the liver (e.g., Wilson's disease, hemochromatosis, cystic fibrosis, biliary atresia, and alpha1-antitrypsin deficiency), portal hypertension, cholelithiasis, and jaundice.

The recitation of "Connective/Epithelial" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), cellular and genetic abnormalities (e.g., as described below under "Diseases at the Cellular Level"), angiogenesis (e.g., as described below under "Anti-Angiogenesis Activity"), and or to promote or inhibit regeneration (e.g., as described below under "Regeneration"), and wound healing (e.g., as described below under "Wound Healing and Epithelial Cell Proliferation").

In specific embodiments, a protein, nucleic acid, or antibody of the invention (or fragment or variant thereof) having a "Connective/Epithelial" recitation in the "Preferred Indication" column of Table 1D, may be used for example, to diagnose, treat, prevent, and/or ameliorate a disease or disorder selected from the group consisting of: connective tissue metaplasia, mixed connective tissue disease, focal epithelial hyperplasia, epithelial metaplasia, mucoepithelial dysplasia, graft v. host disease, polymyositis, cystic hyperplasia, cerebral dysplasia, tissue hypertrophy, Alzheimer's disease, lymphoproliferative disorder, Waldenstron's macroglobulinemia, Crohn's disease, pernicious anemia, idiopathic Addison's disease, glomerulonephritis, bullous pemphigoid, Sjogren's syndrome, diabetes mellitus, cystic fibrosis, osteoblastoma, osteoclastoma, osteosarcoma, chondrosarcoma, osteoporosis, osteocarthritis, periodontal disease, wound healing, relapsing polychondritis, vasculitis, polyarteritis nodosa, Wegener's granulamatosis, cellulitis, rheumatoid arthritis, psoriatic arthritis, discoid lupus erythematosus, systemic lupus erythematosus, scleroderma, CREST syndrome, Sjogren's syndrome, polymyositis, dermatomyositis, mixed connective tissue disease, relapsing polychondritis, vasculitis, Henoch-Schonlein syndrome, erythema nodosum, polyarteritis nodosa, temporal (giant cell) arteritis, Takayasu's arteritis, Wegener's granulomatosis, Reiter's syndrome, Behcet's syndrome, ankylosing spondylitis, cellulitis, keloids, Ehler Danlos syndrome, Marfan syndrome, pseudoxantoma elasticum, osteogenese imperfecta, chondrodysplasias, epidermolysis bullosa, Alport syndrome, and cutis laxa.

TABLE 1C

| Gene No. | cDNA Clone ID: | Preferred Indications: |
|---|---|---|
| 1 | H2CBG48 | Cancer |
| 2 | H2CBU83 | Cancer |
| 3 | H2MAC30 | Cancer |
| 4 | H6EAB28 | Musculoskeletal, Neural/Sensory |
| 5 | H6EDC19 | Cancer |
| 6 | H6EDF66 | Connective/Epithelial, Immune/Hematopoetic, Neural/Sensory |
| 7 | H6EDY30 | Immune/Hematopoetic |
| 8 | HABAG37 | Cancer |
| 9 | HACBD91 | Cancer |
| 10 | HACCI17 | Cancer |
| 11 | HADAO89 | Connective/Epithelial |
| 12 | HADCP14 | Connective/Epithelial, Immune/Hematopoetic |
| 13 | HAGAI85 | Cancer |
| 14 | HAGAM64 | Neural/Sensory |
| 15 | HAGAN21 | Digestive, Immune/Hematopoetic, Neural/Sensory |
| 16 | HAGAQ26 | Cancer |
| 17 | HAGBZ81 | Excretory, Neural/Sensory |
| 18 | HAGDS20 | Neural/Sensory, Reproductive |
| 19 | HAGDS35 | Cancer |
| 20 | HAGFG51 | Neural/Sensory |
| 21 | HAGFI62 | Cancer |
| 22 | HAHDB16 | Cardiovascular |
| 23 | HAHDR32 | Cancer |
| 24 | HAIBO71 | Connective/Epithelial, Digestive, Immune/Hematopoetic |
| 25 | HAIBP89 | Cancer |
| 26 | HAIBU10 | Cancer |
| 27 | HAICP19 | Cancer |
| 28 | HAIFL18 | Digestive, Immune/Hematopoetic |
| 29 | HAJAF57 | Cancer |
| 30 | HAJAN23 | Cancer |
| 31 | HAJBR69 | Cancer |
| 32 | HAJBZ75 | Cancer |
| 33 | HAMFE15 | Cancer |
| 34 | HAMFK58 | Cancer |
| 35 | HAMGG68 | Cancer |
| 36 | HAMGR28 | Cancer |
| 37 | HAPBS03 | Cancer |
| 38 | HAPNY86 | Cancer |
| 39 | HAPNY94 | Cancer |
| 40 | HAPOM49 | Cancer |
| 41 | HAPPW30 | Cancer |
| 42 | HAPQT22 | Cancer |
| 43 | HAPUC89 | Cancer |
| 44 | HASAV70 | Cancer |
| 45 | HASCG84 | Cancer |
| 46 | HATAC53 | Cancer |
| 47 | HATBR65 | Cancer |
| 48 | HATCB92 | Endocrine |
| 49 | HATCP77 | Cancer |
| 50 | HATDM46 | Cancer |
| 51 | HATEE46 | Cancer |
| 52 | HAUAI83 | Reproductive |
| 53 | HBAFJ33 | Cancer |
| 54 | HBAFV19 | Cancer |
| 55 | HBAMB15 | Cardiovascular, Excretory, Reproductive |
| 56 | HBAMB34 | Excretory, Reproductive |
| 57 | HBCPB32 | Neural/Sensory, Reproductive |
| 58 | HBGBA69 | Cancer |
| 59 | HBGNU56 | Cancer |
| 60 | HBHAD12 | Neural/Sensory |
| 61 | HBHMA23 | Cancer |
| 62 | HBIAE26 | Neural/Sensory, Reproductive |
| 63 | HBIBW67 | Digestive, Neural/Sensory, Reproductive |
| 64 | HBINS58 | Connective/Epithelial, Reproductive |
| 65 | HBJFU48 | Immune/Hematopoetic |
| 66 | HBJIY92 | Cancer |
| 67 | HBJLC01 | Immune/Hematopoetic |
| 68 | HBJLF01 | Cancer |
| 69 | HBJLH40 | Digestive, Immune/Hematopoetic, Neural/Sensory |
| 70 | HBJNC59 | Cancer |
| 71 | HBNAW17 | Reproductive |
| 72 | HBOEG11 | Cancer |
| 73 | HBOEG69 | Cancer |
| 74 | HCACU58 | Immune/Hematopoetic |
| 75 | HCACV51 | Cancer |
| 76 | HCDBW86 | Musculoskeletal |
| 77 | HCE1Q89 | Immune/Hematopoetic, Neural/Sensory |
| 78 | HCE2F54 | Cancer |
| 79 | HCE3G69 | Cancer |
| 80 | HCE5F43 | Cancer |
| 81 | HCEFB80 | Cancer |
| 82 | HCEGR33 | Cancer |
| 83 | HCEMP62 | Cancer |
| 84 | HCENK38 | Cancer |
| 85 | HCEWE17 | Digestive, Neural/Sensory |
| 86 | HCEWE20 | Endocrine, Immune/Hematopoetic, Neural/Sensory |
| 87 | HCFCU88 | Immune/Hematopoetic |
| 88 | HCFMV71 | Digestive, Immune/Hematopoetic |
| 89 | HCFNN01 | Digestive, Immune/Hematopoetic, Neural/Sensory |
| 90 | HCFOM18 | Immune/Hematopoetic |
| 91 | HCGMD59 | Cancer |
| 92 | HCHNF25 | Cancer |
| 93 | HCMSQ56 | Cardiovascular |
| 94 | HCMST14 | Cancer |
| 95 | HCMTB45 | Cardiovascular, Mixed Fetal |
| 96 | HCNDR47 | Digestive, Neural/Sensory, Reproductive |
| 97 | HCNSB61 | Digestive, Immune/Hematopoetic |
| 98 | HCNSD93 | Digestive |
| 99 | HCOOS80 | Cancer |
| 100 | HCQCT05 | Digestive, Endocrine, Reproductive |
| 101 | HCUBS50 | Immune/Hematopoetic |
| 102 | HCUCK44 | Cancer |
| 103 | HCUEO60 | Immune/Hematopoetic |
| 104 | HCUGM86 | Immune/Hematopoetic |
| 105 | HCUHK65 | Cancer |
| 106 | HCUIM65 | Cancer |
| 107 | HCWDS72 | Cancer |
| 108 | HCWEB58 | Cancer |
| 109 | HCWGU37 | Immune/Hematopoetic, Neural/Sensory, Reproductive |
| 110 | HCWKC15 | Immune/Hematopoetic |
| 111 | HCWLD74 | Immune/Hematopoetic |
| 112 | HCWUM50 | Cancer |
| 113 | HDABR72 | Cancer |
| 114 | HDHEB60 | Cancer |
| 115 | HDHIA94 | Cancer |
| 116 | HDHMA72 | Cancer |
| 117 | HDLAC10 | Cancer |
| 118 | HDLAO28 | Cancer |
| 119 | HDPBA28 | Cancer |
| 120 | HDPBI32 | Excretory, Immune/Hematopoetic, Neural/Sensory |
| 121 | HDPBQ02 | Immune/Hematopoetic |
| 122 | HDPBQ71 | Cancer |
| 123 | HDPCJ91 | Cancer |
| 124 | HDPCL63 | Cancer |
| 125 | HDPCO25 | Immune/Hematopoetic |
| 126 | HDPCY37 | Cancer |
| 127 | HDPFF39 | Cancer |
| 128 | HDPGI49 | Cancer |
| 129 | HDPGK25 | Cancer |
| 130 | HDPGP94 | Digestive, Immune/Hematopoetic |
| 131 | HDPGT01 | Cancer |
| 132 | HDPHI51 | Immune/Hematopoetic |
| 133 | HDPJF37 | Cancer |
| 134 | HDPJM30 | Cancer |
| 135 | HDPNC61 | Immune/Hematopoetic, Reproductive |
| 136 | HDPND46 | Immune/Hematopoetic |
| 137 | HDPOE32 | Cancer |
| 138 | HDPOH06 | Cancer |
| 139 | HDPOJ08 | Cancer |

TABLE 1C-continued

| Gene No. | cDNA Clone ID: | Preferred Indications: |
|---|---|---|
| 140 | HDPOZ56 | Cancer |
| 141 | HDPPA04 | Cardiovascular, Connective/Epithelial, Immune/Hematopoetic |
| 142 | HDPPH47 | Cancer |
| 143 | HDPPN86 | Cancer |
| 144 | HDPSB18 | Cancer |
| 145 | HDPSH53 | Immune/Hematopoetic, Reproductive |
| 146 | HDPSP01 | Cancer |
| 147 | HDPSP54 | Cancer |
| 148 | HDPSU13 | Immune/Hematopoetic |
| 149 | HDPTD15 | Immune/Hematopoetic |
| 150 | HDPTK41 | Cancer |
| 151 | HDPUG50 | Cancer |
| 152 | HDPUH26 | Cancer |
| 153 | HDPUW68 | Cancer |
| 154 | HDPVH60 | Cancer |
| 155 | HDPWN93 | Cancer |
| 156 | HDPWU34 | Cancer |
| 157 | HDPXY01 | Cancer |
| 158 | HDQHD03 | Neural/Sensory |
| 159 | HDTBPO4 | Digestive, Immune/Hematopoetic |
| 160 | HDTBV77 | Cancer |
| 161 | HDTDQ23 | Cancer |
| 162 | HDTEK44 | Connective/Epithelial, Immune/Hematopoetic, Reproductive |
| 163 | HDTEN81 | Digestive, Immune/Hematopoetic |
| 164 | HDTFE17 | Cancer |
| 165 | HDTGC73 | Cancer |
| 166 | HDTIT10 | Cancer |
| 167 | HDTMK50 | Cancer |
| 168 | HE2DE47 | Cancer |
| 169 | HE2DY70 | Immune/Hematopoetic, Mixed Fetal, Musculoskeletal |
| 170 | HE2EB74 | Cancer |
| 171 | HE2FVO3 | Cancer |
| 172 | HE2NV57 | Cancer |
| 173 | HE2PD49 | Cancer |
| 174 | HE2PH36 | Digestive, Immune/Hematopoetic, Mixed Fetal |
| 175 | HE2PY40 | Mixed Fetal |
| 176 | HE6EU50 | Mixed Fetal |
| 177 | HE8DS15 | Cancer |
| 178 | HE8MH91 | Cancer |
| 179 | HE8QV67 | Cancer |
| 180 | HE9BK23 | Digestive, Mixed Fetal |
| 181 | HE9CO69 | Cancer |
| 182 | HE9CP41 | Immune/Hematopoetic, Mixed Fetal |
| 183 | HE9DG49 | Cancer |
| 184 | HE9HY07 | Mixed Fetal, Reproductive |
| 185 | HE9OW20 | Immune/Hematopoetic, Mixed Fetal, Neural/Sensory |
| 186 | HE9RM63 | Cancer |
| 187 | HEAAR07 | Reproductive |
| 188 | HEBAE88 | Immune/Hematopoetic, Neural/Sensory |
| 189 | HEBBN36 | Cancer |
| 190 | HEBCM63 | Cancer |
| 191 | HEBEJ18 | Cancer |
| 192 | HEEAG23 | Cancer |
| 193 | HEEAJ02 | Cancer |
| 194 | HEEAQ11 | Reproductive |
| 195 | HEGAH43 | Digestive, Reproductive |
| 196 | HEGAN94 | Reproductive |
| 197 | HEGBS69 | Neural/Sensory, Reproductive |
| 198 | HELGK31 | Cancer |
| 199 | HELHD85 | Cancer |
| 200 | HELHL48 | Cancer |
| 201 | HEMAM41 | Cancer |
| 202 | HEOMQ63 | Digestive, Immune/Hematopoetic |
| 203 | HEPAA46 | Reproductive |
| 204 | HEPAB80 | Reproductive |
| 205 | HEPAD91 | Connective/Epithelial, Reproductive |
| 206 | HEQAK71 | Cancer |
| 207 | HEQCC55 | Cancer |
| 208 | HERAD40 | Connective/Epithelial |
| 209 | HERAR44 | Connective/Epithelial, Reproductive |
| 210 | HESAJ10 | Cancer |
| 211 | HETAB45 | Cancer |
| 212 | HETBR16 | Digestive, Inimune/Hematopoetic, Reproductive |
| 213 | HETEU28 | Cancer |
| 214 | HETLM70 | Cancer |
| 215 | HFABG18 | Cancer |
| 216 | HFABH95 | Digestive, Neural/Sensory, Reproductive |
| 217 | HFAEF57 | Neural/Sensory |
| 218 | HFAMH77 | Cancer |
| 219 | HFCCQ50 | Cancer |
| 220 | HFCDK17 | Cancer |
| 221 | HFCEB37 | Cancer |
| 222 | HFFAD59 | Neural/Sensory |
| 223 | HFFAL36 | Neural/Sensory |
| 224 | HFGAD82 | Cancer |
| 225 | HFIIN69 | Musculoskeletal, Neural/Sensory, Reproductive |
| 226 | HFKET18 | Cancer |
| 227 | HFKFG02 | Excretory, Immune/Hematopoetic, Neural/Sensory |
| 228 | HFLNB64 | Cancer |
| 229 | HFOXB13 | Musculoskeletal |
| 230 | HFPAC12 | Cancer |
| 231 | HFPCXO9 | Mixed Fetal, Neural/Sensory |
| 232 | HFPCX36 | Neural/Sensory |
| 233 | HFPCX64 | Mixed Fetal, Neural/Sensory |
| 234 | HFRAN90 | Neural/Sensory |
| 235 | HFTBM50 | Cancer |
| 236 | HFTCU19 | Cancer |
| 237 | HFTDL56 | Cancer |
| 238 | HFTDZ36 | Cancer |
| 239 | HFVGE32 | Digestive, Immune/Hematopoetic |
| 240 | HFXAM76 | Cancer |
| 241 | HFXBL33 | Cancer |
| 242 | HFXDJ75 | Neural/Sensory |
| 243 | HFXDN63 | Neural/Sensory |
| 244 | HFXGT26 | Cancer |
| 245 | HFXGV31 | Neural/Sensory |
| 246 | HFXHD88 | Neural/Sensory |
| 247 | HFXJK73 | Neural/Sensory |
| 248 | HFXJX44 | Cancer |
| 249 | HFXKJ03 | Cardiovascular, Immune/Hematopoetic, Neural/Sensory |
| 250 | HFXKY27 | Neural/Sensory |
| 251 | HGBFO79 | Cancer |
| 252 | HGBHE57 | Cancer |
| 253 | HGBHI35 | Cancer |
| 254 | HGBIB74 | Cancer |
| 255 | HGLAF75 | Digestive, Immune/Hematopoetic, Reproductive |
| 256 | HGLAL82 | Immune/Hematopoetic, Reproductive |
| 257 | HHAAF20 | Cancer |
| 258 | HHBCS39 | Cancer |
| 259 | HHEAA08 | Immune/Hematopoetic |
| 260 | HHEBB10 | Cancer |
| 261 | HHEMA59 | Cancer |
| 262 | HHEMA75 | Cancer |
| 263 | HHEMM74 | Cancer |
| 264 | HHENP27 | Cancer |
| 265 | HHENQ22 | Immune/Hematopoetic |
| 266 | HHENV10 | Immune/Hematopoetic |
| 267 | HHEPD24 | Immune/Hematopoetic |
| 268 | HHEPM33 | Cancer |
| 269 | HHEPT60 | Cancer |
| 270 | HHEPU04 | Cancer |
| 271 | HHFBY53 | Cancer |
| 272 | HHFEC49 | Cancer |
| 273 | HHFFJ48 | Cardiovascular, Immune/Hematopoetic |
| 274 | HHFGR93 | Cancer |
| 275 | HHFHJ59 | Cancer |
| 276 | HHFHR32 | Cancer |
| 277 | HHFOJ29 | Cancer |
| 278 | HHGBO91 | Digestive, Reproductive |
| 279 | HHGCG53 | Cancer |
| 280 | HHGCM76 | Cancer |
| 281 | HHGCQ54 | Cancer |
| 282 | HHGDF16 | Cancer |
| 283 | HHGDW43 | Cancer |
| 284 | HHPDX20 | Neural/Sensory |
| 285 | HHPEN62 | Cancer |
| 286 | HHPGO40 | Cancer |

TABLE 1C-continued

| Gene No. | cDNA Clone ID: | Preferred Indications: |
|---|---|---|
| 287 | HHPTJ65 | Cardiovascular, Musculoskeletal, Neural/Sensory |
| 288 | HHSDX28 | Immune/Hematopoetic, Neural/Sensory |
| 289 | HHSGW69 | Cancer |
| 290 | HHTLF25 | Cancer |
| 291 | HILCF66 | Cancer |
| 292 | HJACA79 | Immune/Hematopoetic |
| 293 | HJACG30 | Immune/Hematopoetic |
| 294 | HJBAV55 | Cancer |
| 295 | HJBCU04 | Cancer |
| 296 | HJBCY35 | Cancer |
| 297 | HJMBI18 | Cancer |
| 298 | HJMBM38 | Cancer |
| 299 | HJMBT65 | Cancer |
| 300 | HJMBW30 | Cancer |
| 301 | HJPAD75 | Cancer |
| 302 | HJPCP42 | Cardiovascular, Immune/Hematopoetic |
| 303 | HKAAE44 | Cancer |
| 304 | HKAAH36 | Connective/Epithelial, Reproductive |
| 305 | HKAAK02 | Cancer |
| 306 | HKABI84 | Cancer |
| 307 | HKABZ65 | Connective/Epithelial |
| 308 | HKACB56 | Connective/Epithelial |
| 309 | HKACD58 | Cancer |
| 310 | HKACH44 | Cancer |
| 311 | HKACM93 | Cancer |
| 312 | HKAEG43 | Cancer |
| 313 | HKAEL80 | Connective/Epithelial, Immune/Hematopoetic |
| 314 | HKAEV06 | Cancer |
| 315 | HKAFK41 | Cancer |
| 316 | HKAFT66 | Connective/Epithelial, Digestive, Immune/Hematopoetic |
| 317 | HKB1E57 | Cancer |
| 318 | HKDBF34 | Cancer |
| 319 | HKFBC53 | Cancer |
| 320 | HKGAT94 | Digestive, Reproductive |
| 321 | HKGCO27 | Cancer |
| 322 | HKGDL36 | Cancer |
| 323 | HKISB57 | Cancer |
| 324 | HKIYH57 | Cancer |
| 325 | HKMLP68 | Excretory, Reproductive |
| 326 | HKMMD13 | Excretory |
| 327 | HKMMW74 | Excretory |
| 328 | HKMND01 | Excretory |
| 329 | HL2AG57 | Immune/Hematopoetic, Reproductive |
| 330 | HLCND09 | Cancer |
| 331 | HLDBE54 | Digestive, Reproductive |
| 332 | HLDBX13 | Digestive |
| 333 | HLDNA86 | Cancer |
| 334 | HLDON23 | Cancer |
| 335 | HLDOW79 | Digestive |
| 336 | HLDQC46 | Cancer |
| 337 | HLDQR62 | Cancer |
| 338 | HLDQU79 | Cancer |
| 339 | HLDRM43 | Digestive, Reproductive |
| 340 | HLDRP33 | Digestive, Neural/Sensory |
| 341 | HLHAL68 | Respiratory |
| 342 | HLHFP03 | Respiratory |
| 343 | HLIBD68 | Cancer |
| 344 | HLICQ90 | Cancer |
| 345 | HLJBJ61 | Cancer |
| 346 | HLMBO76 | Digestive, Immune/Hematopoetic, Reproductive |
| 347 | HLMCA59 | Immune/Hematopoetic |
| 348 | HLQBE09 | Digestive |
| 349 | HLQDR48 | Digestive |
| 350 | HLQEM64 | Cancer |
| 351 | HLTAU74 | Cancer |
| 352 | HLTCO33 | Immune/Hematopoetic, Neural/Sensory, Reproductive |
| 353 | HLTDV50 | Immune/Hematopoetic, Respiratory |
| 354 | HLTEJ06 | Digestive, Immune/Hematopoetic |
| 355 | HLTFA64 | Cancer |
| 356 | HLTHG37 | Cancer |
| 357 | HLTHR66 | Cancer |
| 358 | HLTIP94 | Immune/Hematopoetic, Mixed Fetal, Neural/Sensory |
| 359 | HLWAA17 | Cancer |
| 360 | HLWAA88 | Cancer |
| 361 | HLWAD77 | Cancer |
| 362 | HLWAE11 | Cardiovascular, Immune/Hematopoetic, Reproductive |
| 363 | HLWAO22 | Cancer |
| 364 | HLWAY54 | Immune/Hematopoetic, Neural/Sensory, Reproductive |
| 365 | HLWBH18 | Reproductive |
| 366 | HLWBI63 | Cancer |
| 367 | HLWBK05 | Cancer |
| 368 | HLWBY76 | Cancer |
| 369 | HLWCF05 | Cancer |
| 370 | HLYAC95 | Immune/Hematopoetic |
| 371 | HLYAF80 | Immune/Hematopoetic |
| 372 | HLYAN59 | Immune/Hematopoetic |
| 373 | HLYAP91 | Digestive, Immune/Hematopoetic, Reproductive |
| 374 | HLYBD32 | Immune/Hematopoetic |
| 375 | HLYES38 | Immune/Hematopoetic, Reproductive |
| 376 | HMADK33 | Cancer |
| 377 | HMADS41 | Cancer |
| 378 | HMADU73 | Cancer |
| 379 | HMAMI15 | Cancer |
| 380 | HMCFY13 | Immune/Hematopoetic, Reproductive |
| 381 | HMDAB56 | Immune/Hematopoetic, Neural/Sensory |
| 382 | HMDAE65 | Neural/Sensory |
| 383 | HMDAM24 | Cancer |
| 384 | HMDAN54 | Immune/Hematopoetic, Neural/Sensory |
| 385 | HMDAQ29 | Neural/Sensory, Reproductive |
| 386 | HMEAI48 | Cardiovascular |
| 387 | HMECK83 | Cardiovascular |
| 388 | HMEED18 | Cancer |
| 389 | HMEET96 | Cancer |
| 390 | HMEFT54 | Cardiovascular, Digestive, Reproductive |
| 391 | HMEGF92 | Cardiovascular |
| 392 | HMIAP86 | Cancer |
| 393 | HMKCG09 | Digestive, Endocrine, Neural/Sensory |
| 394 | HMMAH60 | Immune/Hematopoetic |
| 395 | HMQDF12 | Cancer |
| 396 | HMSBX80 | Immune/Hematopoetic, Reproductive |
| 397 | HMSDL37 | Cancer |
| 398 | HMSFI26 | Immune/Hematopoetic |
| 399 | HMSFS21 | Digestive, Immune/Hematopoetic |
| 400 | HMSGB14 | Immune/Hematopoetic |
| 401 | HMSGT42 | Cancer |
| 402 | HMSGU01 | Cancer |
| 403 | HMSHM14 | Immune/Hematopoetic |
| 404 | HMSHS36 | Immune/Hematopoetic |
| 405 | HMSJM65 | Cancer |
| 406 | HMSJU68 | Cancer |
| 407 | HMSKC04 | Immune/Hematopoetic |
| 408 | HMTBI36 | Cancer |
| 409 | HMUAP70 | Cancer |
| 410 | HMVBN46 | Immune/Hematopoetic, Neural/Sensory |
| 411 | HMVBS81 | Cancer |
| 412 | HMWDC28 | Cancer |
| 413 | HMWEB02 | Cancer |
| 414 | HN4WFO02 | Immune/Hematopoetic |
| 415 | HMWFT65 | Immune/Hematopoetic |
| 416 | HMWGY65 | Cancer |
| 417 | HNEAC05 | Immune/Hematopoetic |
| 418 | HNEEB45 | Immune/Hematopoetic, Mixed Fetal |
| 419 | HNEEE24 | Immune/Hematopoetic |
| 420 | HNFFC43 | Cancer |
| 421 | HNFGF20 | Cardiovascular, Immune/Hematopoetic |
| 422 | HNFIY77 | Cancer |
| 423 | HNFJF07 | Immune/Hematopoetic, Neural/Sensory |
| 424 | HNFJH45 | Immune/Hematopoetic |
| 425 | HNGAK47 | Immune/Hematopoetic |
| 426 | HNGAP93 | Cancer |
| 427 | HNGBC07 | Immune/Hematopoetic |
| 428 | HNGBT31 | Immune/Hematopoetic |
| 429 | HNGDG40 | Immune/Hematopoetic |
| 430 | HNGDJ72 | Immune/Hematopoetic |
| 431 | HNGDU40 | Immune/Hematopoetic |
| 432 | HNGEG08 | Immune/Hematopoetic |
| 433 | HNGEP09 | Immune/Hematopoetic |

TABLE 1C-continued

| Gene No. | cDNA Clone ID: | Preferred Indications: |
|---|---|---|
| 434 | HNGFR31 | Immune/Hematopoetic |
| 435 | HNGHR74 | Immune/Hematopoetic |
| 436 | HNGIH43 | Immune/Hematopoetic, Reproductive |
| 437 | HNGIJ31 | Cancer |
| 438 | HNGJE50 | Immune/Hematopoetic |
| 439 | HNGJO57 | Immune/Hematopoetic |
| 440 | HNGJT54 | Immune/Hematopoetic |
| 441 | HNGND37 | Cancer |
| 442 | HNGOI12 | Immune/Hematopoetic |
| 443 | HNGOM56 | Immune/Hematopoetic |
| 444 | HNGOU56 | Immune/Hematopoetic |
| 445 | HNGOW62 | Immune/Hematopoetic |
| 446 | HNHAH01 | Immune/Hematopoetic |
| 447 | HNHCX60 | Immune/Hematopoetic |
| 448 | HNHCY64 | Immune/Hematopoetic |
| 449 | HNHCY94 | Immune/Hematopoetic |
| 450 | HNHDW38 | Immune/Hematopoetic |
| 451 | HNHDW42 | Immune/Hematopoetic |
| 452 | HNHED17 | Immune/Hematopoetic |
| 453 | HNHEI42 | Immune/Hematopoetic |
| 454 | HNHEU93 | Immune/Hematopoetic |
| 455 | HNHFM14 | Cancer |
| 456 | HNHFR04 | Immune/Hematopoetic |
| 457 | HNHFU32 | Immune/Hematopoetic |
| 458 | HNHNB29 | Immune/Hematopoetic |
| 459 | HNHOD46 | Immune/Hematopoetic |
| 460 | HNHOG73 | Immune/Hematopoetic |
| 461 | HNTBI26 | Cancer |
| 462 | HNTBL27 | Cancer |
| 463 | HNTCE26 | Cancer |
| 464 | HNTNC20 | Cancer |
| 465 | HNTNI01 | Cancer |
| 466 | HNTSY18 | Cardiovascular, Reproductive |
| 467 | HOAAC90 | Musculoskeletal |
| 468 | HOACB38 | Musculoskeletal |
| 469 | HOCNF19 | Digestive |
| 470 | HODDF13 | Reproductive |
| 471 | HODDN65 | Reproductive |
| 472 | HODDN92 | Cancer |
| 473 | HODDO08 | Cancer |
| 474 | HODDW40 | Cardiovascular, Immune/Hematopoetic, Reproductive |
| 475 | HODEJ32 | Reproductive |
| 476 | HODFN71 | Mixed Fetal, Reproductive |
| 477 | HODGE68 | Reproductive |
| 478 | HOEBK34 | Digestive, Musculoskeletal |
| 479 | HOEBZ89 | Cancer |
| 480 | HOEDB32 | Cancer |
| 481 | HOEDE28 | Cancer |
| 482 | HOEDH84 | Cancer |
| 483 | HOFMQ33 | Reproductive |
| 484 | HOFMT75 | Cancer |
| 485 | HOFND85 | Cancer |
| 486 | HOFNY91 | Cancer |
| 487 | HOFOC33 | Reproductive |
| 488 | HOGAW62 | Immune/Hematopoetic, Reproductive |
| 489 | HOGCK20 | Cancer |
| 490 | HOGCK63 | Cancer |
| 491 | HOGCS52 | Cancer |
| 492 | HOHBB49 | Musculoskeletal |
| 493 | HOHBC68 | Musculoskeletal, Reproductive |
| 494 | HOHBY12 | Musculoskeletal |
| 495 | HOHBY44 | Cancer |
| 496 | HOHCC74 | Musculoskeletal |
| 497 | HOHCH55 | Cancer |
| 498 | HOQBJ82 | Cancer |
| 499 | HOSBY40 | Digestive, Immune/Hematopoetic, Musculoskeletal |
| 500 | HOSDJ25 | Cancer |
| 501 | HOSEG51 | Endocrine, Immune/Hematopoetic, Musculoskeletal |
| 502 | HOSEQ49 | Cancer |
| 503 | HOSFDS8 | Cancer |
| 504 | HOUCQ17 | Cancer |
| 505 | HOUDK26 | Connective/Epithelial, Digestive, Neural/Sensory |
| 506 | HOUGG12 | Cancer |
| 507 | HOVCA92 | Immune/Hematopoetic, Reproductive |
| 508 | HPASA81 | Digestive, Endocrine, Reproductive |
| 509 | HPBCU51 | Cancer |
| 510 | HPDDC77 | Cancer |
| 511 | HPDWP28 | Reproductive |
| 512 | HPEAD79 | Reproductive |
| 513 | HPFCL43 | Cancer |
| 514 | HPFDG48 | Digestive, Immune/Hematopoetic, Reproductive |
| 515 | HPIAQ68 | Immune/Hematopoetic, Reproductive |
| 516 | HPIBO15 | Cancer |
| 517 | HPICB53 | Reproductive |
| 518 | HPJBI33 | Reproductive |
| 519 | HPJBK12 | Reproductive |
| 520 | HPJCL22 | Cancer |
| 521 | HPJCW04 | Reproductive |
| 522 | HPJEX20 | Immune/Hematopoetic, Reproductive |
| 523 | HPMAI22 | Digestive, Immune/Hematopoetic, Reproductive |
| 524 | HPMDK28 | Cancer |
| 525 | HPMFP40 | Reproductive |
| 526 | HPMGJ45 | Cancer |
| 527 | HPQAC69 | Digestive |
| 528 | HPRAL78 | Cancer |
| 529 | HPRBC80 | Cancer |
| 530 | HPRBF19 | Cancer |
| 531 | HPTTG19 | Endocrine, Immune/Hematopoetic |
| 532 | HPVAB94 | Reproductive |
| 533 | HPWAY46 | Cancer |
| 534 | HPWDJ42 | Digestive, Reproductive |
| 535 | HPZAB47 | Cancer |
| 536 | HRAAB15 | Cancer |
| 537 | HRABA80 | Excretory |
| 538 | HRACD15 | Cancer |
| 539 | HRACD80 | Digestive, Excretory |
| 540 | HRACJ35 | Cancer |
| 541 | HRADL70 | Excretory, Immune/Hematopoetic |
| 542 | HRDDV47 | Cancer |
| 543 | HRDFD27 | Immune/Hematopoetic, Musculoskeletal |
| 544 | HRGBL78 | Cancer |
| 545 | HROAJ03 | Cancer |
| 546 | HROAJ39 | Digestive, Immune/Hematopoetic |
| 547 | HROBD68 | Cancer |
| 548 | HRTAE58 | Digestive |
| 549 | HSATR82 | Immune/Hematopoetic |
| 550 | HSAUK57 | Immune/Hematopoetic |
| 551 | HSAUL82 | Immune/Hematopoetic |
| 552 | HSAVH65 | Digestive, Immune/Hematopoetic, Reproductive |
| 553 | HSAVK10 | Immune/Hematopoetic |
| 554 | HSAWD74 | Cancer |
| 555 | HSAWZ41 | Immune/Hematopoetic |
| 556 | HSAXA83 | Cancer |
| 557 | HSAYB43 | Immune/Hematopoetic |
| 558 | HSAYM40 | Immune/Hematopoetic |
| 559 | HSDAJ46 | Mixed Fetal, Neural/Sensory |
| 560 | HSDEK49 | Cancer |
| 561 | HSDER95 | Connective/Epithelial, Digestive, Neural/Sensory |
| 562 | HSDFJ26 | Cancer |
| 563 | HSDJA15 | Cancer |
| 564 | HSDIJ82 | Neural/Sensory |
| 565 | HSDJM31 | Digestive, Neural/Sensory |
| 566 | HSDSB09 | Digestive, Excretory, Neural/Sensory |
| 567 | HSDSE75 | Cancer |
| 568 | HSDZR57 | Cancer |
| 569 | HSHAX21 | Cancer |
| 570 | HSIAS17 | Cancer |
| 571 | HSIDJ81 | Digestive |
| 572 | HSIDX71 | Digestive, Neural/Sensory |
| 573 | HSJBQ79 | Cancer |
| 574 | HSKDA27 | Cancer |
| 575 | HSKGN81 | Cancer |
| 576 | HSKHZ81 | Cancer |
| 577 | HSKNB56 | Cancer |
| 578 | HSLCQ82 | Cancer |
| 579 | HSLJG37 | Cancer |
| 580 | HSNAB12 | Cardiovascular |
| 581 | HSNAD72 | Cancer |
| 582 | HSNMC45 | Cancer |
| 583 | HSODE04 | Digestive |
| 584 | HSPBF70 | Cancer |

TABLE 1C-continued

| Gene No. | cDNA Clone ID: | Preferred Indications: |
|---|---|---|
| 585 | HSQFP66 | Excretory, Neural/Sensory |
| 586 | HSRFZ57 | Musculoskeletal |
| 587 | HSSAJ29 | Musculoskeletal, Neural/Sensory |
| 588 | HSSDX51 | Cancer |
| 589 | HSSFT08 | Musculoskeletal |
| 590 | HSSGD52 | Cancer |
| 591 | HSSGG82 | Cancer |
| 592 | HSSJC35 | Cancer |
| 593 | HSTBJ86 | Connective/Epithelial |
| 594 | HSUBW09 | Digestive, Immune/Hematopoetic |
| 595 | HSVAM10 | Cancer |
| 596 | HSVBU91 | Cancer |
| 597 | HSXCG83 | Cancer |
| 598 | HSXEQ06 | Cancer |
| 599 | HSXGI47 | Cancer |
| 600 | HSYAV50 | Cancer |
| 601 | HSYAV66 | Digestive, Immune/Hematopoetic |
| 602 | HSYAZ50 | Cancer |
| 603 | HSYAZ63 | Cancer |
| 604 | HSYBG37 | Cancer |
| 605 | HT3SF53 | Cancer |
| 606 | HT5GJ57 | Cancer |
| 607 | HTADW91 | Cancer |
| 608 | HTADX17 | Immune/Hematopoetic, Reproductive |
| 609 | HTAEE28 | Digestive, Immune/Hematopoetic, Mixed Fetal |
| 610 | HTDAF28 | Cancer |
| 611 | HTEAF65 | Excretory, Reproductive |
| 612 | HTEAM34 | Reproductive |
| 613 | HTEAM34 | Reproductive |
| 614 | HTEBI28 | Reproductive |
| 615 | HTEBV72 | Reproductive |
| 616 | HTECC05 | Cancer |
| 617 | HTEDF80 | Reproductive |
| 618 | HTEDY42 | Reproductive |
| 619 | HTEEB42 | Cancer |
| 620 | HTEFU65 | Cancer |
| 621 | HTEGA76 | Reproductive |
| 622 | HTEGI42 | Cancer |
| 623 | HTEHR24 | Cancer |
| 624 | HTEIP36 | Reproductive |
| 625 | HTEIV80 | Reproductive |
| 626 | HTEJN13 | Neural/Sensory, Reproductive |
| 627 | HTELM16 | Reproductive |
| 628 | HTELP17 | Cancer |
| 629 | HTELS08 | Reproductive |
| 630 | HTEPG70 | Reproductive |
| 631 | HTGAU75 | Immune/Hematopoetic |
| 632 | HTGEP89 | Immune/Hematopoetic, Neural/Sensory |
| 633 | HTHBG43 | Immune/Hematopoetic |
| 634 | HTHCA18 | Immune/Hematopoetic |
| 635 | HTHDJ94 | Cancer |
| 636 | HTHDS25 | Endocrine, Immune/Hematopoetic |
| 637 | HTJMA95 | Cancer |
| 638 | HTJML75 | Cancer |
| 639 | HTLBE23 | Reproductive |
| 640 | HTLEP53 | Reproductive |
| 641 | HTLFE42 | Cardiovascular, Digestive, Reproductive |
| 642 | HTLFE57 | Cancer |
| 643 | HTLGE31 | Immune/Hematopoetic, Reproductive |
| 644 | HTLHY14 | Immune/Hematopoetic, Neural/Sensory, Reproductive |
| 645 | HTLIT32 | Reproductive |
| 646 | HTLTV19 | Reproductive |
| 647 | HTNBO91 | Cancer |
| 648 | HTOAK16 | Cancer |
| 649 | HTODK73 | Cancer |
| 650 | HTODO72 | Immune/Hematopoetic |
| 651 | HTOGR42 | Immune/Hematopoetic |
| 652 | HTOHT18 | Cancer |
| 653 | HTOIY21 | Immune/Hematopoetic |
| 654 | HTOIZ02 | Cancer |
| 655 | HTOJA73 | Immune/Hematopoetic |
| 656 | HTOJK60 | Cancer |
| 657 | HTPBW79 | Cancer |
| 658 | HTPCS72 | Cancer |
| 659 | HTSEW17 | Immune/Hematopoetic, Reproductive |
| 660 | HTTBI76 | Cancer |
| 661 | HTTBS64 | Reproductive |
| 662 | HTTDB46 | Digestive, Reproductive |
| 663 | HTWCT03 | Cancer |
| 664 | HTWDF76 | Immune/Hematopoetic |
| 665 | HTWJK32 | Cancer |
| 666 | HTWKE60 | Cancer |
| 667 | HTXAJ12 | Immune/Hematopoetic |
| 668 | HTXCV12 | Cancer |
| 669 | HTXDW56 | Cancer |
| 670 | HTXFL30 | Cancer |
| 671 | HTXJM03 | Cancer |
| 672 | HTXKF95 | Cancer |
| 673 | HTXKP61 | Cancer |
| 674 | HUDBZ89 | Cancer |
| 675 | HUFBY15 | Digestive, Musculoskeletal, Reproductive |
| 676 | HUFCJ30 | Cancer |
| 677 | HUFEF62 | Digestive |
| 678 | HUKAH51 | Cancer |
| 679 | HUKBT29 | Cancer |
| 680 | HUSAT94 | Cancer |
| 681 | HUSBA88 | Cancer |
| 682 | HUSIG64 | Cancer |
| 683 | HUSXS50 | Cancer |
| 684 | HUVEB53 | Cancer |
| 685 | HWAAD63 | Endocrine, Excretory, Immune/Hematopoetic |
| 686 | HWABA81 | Immune/Hematopoetic |
| 687 | HWABY10 | Cancer |
| 688 | HWADJ89 | Immune/Hematopoetic |
| 689 | HWBAO62 | Connective/Epithelial, Immune/Hematopoetic |
| 690 | HWBAR14 | Cancer |
| 691 | HWBCB89 | Cancer |
| 692 | HWBCP79 | Immune/Hematopoetic, Reproductive |
| 693 | HWBDP28 | Cancer |
| 694 | HWBEM18 | Cancer |
| 695 | HWBFE57 | Connective/Epithelial, Excretory, Immune/Hematopoetic |
| 696 | HWBFX31 | Cancer |
| 697 | HWDAC39 | Connective/Epithelial |
| 698 | HWDAH38 | Connective/Epithelial |
| 699 | HWHGP71 | Connective/Epithelial, Immune/Hematopoetic, Reproductive |
| 700 | HWHGQ49 | Cancer |
| 701 | HWHGU54 | Connective/Epithelial |
| 702 | HWHGZ51 | Cancer |
| 703 | HWHHL34 | Cancer |
| 704 | HWLEV32 | Cancer |
| 705 | HWLIH65 | Cancer |
| 706 | HWTBK81 | Cancer |
| 707 | HYAAJ71 | Immune/Hematopoetic |
| 708 | HYBAR01 | Musculoskeletal |
| 709 | H6EDX46 | Cancer |
| 710 | HAGDG59 | Cancer |
| 711 | HAMFC93 | Cancer |
| 712 | HAPOB80 | Immune/Hematopoetic, Musculoskeletal |
| 713 | HATDF29 | Cancer |
| 714 | HBIMB51 | Connective/Epithelial, Reproductive |
| 715 | HBJID05 | Immune/Hematopoetic |
| 716 | HBJJU28 | Immune/Hematopoetic, Neural/Sensory |
| 717 | HBXFL29 | Cancer |
| 718 | HCEEA88 | Cancer |
| 719 | HCEFB69 | Cancer |
| 720 | HCNSM70 | Cancer |
| 721 | HDHMA45 | Cardiovascular, Neural/Sensory |
| 722 | HDPFP29 | Cancer |
| 723 | HDTBD53 | Cancer |
| 724 | HE2EN04 | Cancer |
| 725 | HE8UB86 | Mixed Fetal, Reproductive |
| 726 | HFAMB72 | Cancer |
| 727 | HFIIZ70 | Cancer |
| 728 | HFIUR10 | Digestive, Immune/Hematopoetic, Musculoskeletal |
| 729 | HFOXA73 | Musculoskeletal |
| 730 | HFPAO71 | Cancer |
| 731 | HFVAB79 | Cardiovascular, Digestive, Reproductive |
| 732 | HFXJU68 | Immune/Hematopoetic, Neural/Sensory |
| 733 | HFXKT05 | Cancer |

TABLE 1C-continued

| Gene No. | cDNA Clone ID: | Preferred Indications: |
|---|---|---|
| 734 | HHENK42 | Immune/Hematopoetic |
| 735 | HHPEC09 | Cancer |
| 736 | HJABB94 | Cancer |
| 737 | HJABT47 | Cancer |
| 738 | HJABX32 | Cancer |
| 739 | HJMBN89 | Cancer |
| 740 | HKADQ91 | Cancer |
| 741 | HKIYP40 | Cancer |
| 742 | HKMLK53 | Excretory, Mixed Fetal |
| 743 | HKMLM11 | Cancer |
| 744 | HKMLN27 | Cancer |
| 745 | HLHFR58 | Cancer |
| 746 | HLQDH79 | Cancer |
| 747 | HLYAZ61 | Immune/Hematopoetic |
| 748 | HLYBI15 | Immune/Hematopoetic |
| 749 | HMIAL37 | Digestive, Neural/Sensory, Reproductive |
| 750 | HMQDT36 | Cancer |
| 751 | HMTAD67 | Cancer |
| 752 | HMWFY10 | Cardiovascular, Immune/Hematopoetic, Neural/Sensory |
| 753 | HNGAJ15 | Immune/Hematopoetic, Neural/Sensory |
| 754 | HNGEO29 | Immune/Hematopoetic |
| 755 | HNGIQ46 | Immune/Hematopoetic |
| 756 | HNGJP69 | Immune/Hematopoetic |
| 757 | HNHFO29 | Immune/Hematopoetic |
| 758 | HOFNC14 | Reproductive |
| 759 | HOFOC73 | Cancer |
| 760 | HOHCK70 | Cancer |
| 761 | HPRSB76 | Reproductive |
| 762 | HPWAZ95 | Reproductive |
| 763 | HSABG21 | Reproductive |
| 764 | HSAVD46 | Immune/Hematopoetic, Mixed Fetal, Reproductive |
| 765 | HSDEZ20 | Neural/Sensory |
| 766 | HSFAM31 | Immune/Hematopoetic |
| 767 | HSQCM10 | Cancer |
| 768 | HSXEC75 | Cancer |
| 769 | HSZAF47 | Mixed Fetal |
| 770 | HTEHU31 | Cancer |
| 771 | HTEHU93 | Reproductive |
| 772 | HTOHD42 | Immune/Hematopoetic |
| 773 | HTOHM15 | Cancer |
| 774 | HTPIH83 | Digestive, Reproductive |
| 775 | HTXON32 | Immune/Hematopoetic |
| 776 | HWBAR88 | Cancer |
| 777 | HWHQS55 | Cancer |
| 778 | HYABK95 | Cancer |
| 779 | HYBBE75 | Musculoskeletal |
| 780 | H2CAA57 | Cancer |
| 781 | H2CBH03 | Cancer |
| 782 | H2CBJ08 | Cancer |
| 783 | H2CBK33 | Cancer |
| 784 | H2CBT75 | Cancer |
| 785 | H2MBB56 | Cancer |
| 786 | H2MBT68 | Cancer |
| 787 | H2MBY03 | Cancer |
| 788 | H6BSD90 | Cancer |
| 789 | H6BSG32 | Cardiovascular, Immune/Hematopoetic, Musculoskeletal |
| 790 | H6EAA53 | Cancer |
| 791 | H6EAE26 | Musculoskeletal, Neural/Sensory |
| 792 | H6EEW11 | Neural/Sensory, Reproductive |
| 793 | H6EEW15 | Cancer |
| 794 | H7TBA62 | Cancer |
| 795 | H7TMD22 | Neural/Sensory |
| 796 | HA5BM53 | Cancer |
| 797 | HAAAI67 | Cancer |
| 798 | HACAA29 | Cancer |
| 799 | HACBD86 | Connective/Epithelial |
| 800 | HACBH16 | Connective/Epithelial |
| 801 | HACBI61 | Cancer |
| 802 | HACBS38 | Cancer |
| 803 | HACBZ59 | Cancer |
| 804 | HACCL63 | Cancer |
| 805 | HADAE74 | Cancer |
| 806 | HADCL29 | Connective/Epithelial |
| 807 | HADCL55 | Cancer |
| 808 | HADCL76 | Cancer |
| 809 | HADC045 | Cancer |
| 810 | HADCW30 | Connective/Epithelial |
| 811 | HADDH60 | Connective/Epithelial, Immune/Hematopoetic, Neural/Sensory |
| 812 | HADDZ85 | Connective/Epithelial, Immune/Hematopoetic, Neural/Sensory |
| 813 | HADEH21 | Cancer |
| 814 | HADFF38 | Cancer |
| 815 | HADFK68 | Connective/Epithelial |
| 816 | HADFV30 | Cancer |
| 817 | HADFY83 | Cancer |
| 818 | HADGD17 | Connective/Epithelial, Reproductive |
| 819 | HADGD33 | Connective/Epithelial, Neural/Sensory, Reproductive |
| 820 | HADGG19 | Connective/Epithelial, Musculoskeletal |
| 821 | HADMC21 | Cancer |
| 822 | HAEAB66 | Cancer |
| 823 | HAEAV45 | Cardiovascular, Reproductive |
| 824 | HAFBD61 | Cancer |
| 825 | HAGAI11 | Cancer |
| 826 | HAGAM03 | Immune/Hematopoetic, Neural/Sensory |
| 827 | HAGA039 | Digestive, Neural/Sensory, Reproductive |
| 828 | HAGBD57 | Excretory, Neural/Sensory |
| 829 | HAGBP70 | Cancer |
| 830 | HAGBR89 | Neural/Sensory |
| 831 | HAGBX03 | Neural/Sensory |
| 832 | HAGCH75 | Cancer |
| 833 | HAGCT73 | Cancer |
| 834 | HAGDI35 | Cancer |
| 835 | HAGDO20 | Cancer |
| 836 | HAGDQ42 | Cancer |
| 837 | HAGDQ47 | Cancer |
| 838 | HAGDU63 | Cancer |
| 839 | HAGEA31 | Neural/Sensory |
| 840 | HAGEB14 | Cancer |
| 841 | HAGEW82 | Cancer |
| 842 | HAGFB60 | Neural/Sensory |
| 843 | HAGFD18 | Cancer |
| 844 | HAGFE79 | Immune/Hematopoetic, Neural/Sensory, Reproductive |
| 845 | HAGFH53 | Cardiovascular, Musculoskeletal, Neural/Sensory |
| 846 | HAGFM45 | Cancer |
| 847 | HAGFT48 | Cancer |
| 848 | HAGFY16 | Cancer |
| 849 | HAGGJ80 | Cancer |
| 850 | HAGGS43 | Neural/Sensory |
| 851 | HAGHD57 | Cancer |
| 852 | HAGHR69 | Cancer |
| 853 | HAHDZ77 | Cardiovascular, Mixed Fetal |
| 854 | HAHFU44 | Cardiovascular, Digestive, Musculoskeletal |
| 855 | HAIBE65 | Cancer |
| 856 | HAJBO81 | Neural/Sensory |
| 857 | HAIBX96 | Cancer |
| 858 | HAIBZ39 | Cancer |
| 859 | HAICJ23 | Cancer |
| 860 | HAICJ56 | Cancer |
| 861 | HAIDK60 | Mixed Fetal |
| 862 | HAJAB01 | Cancer |
| 863 | HAJAR23 | Cancer |
| 864 | HAJAW31 | Cancer |
| 865 | HAJAW93 | Cancer |
| 866 | HAJAY88 | Immune/Hematopoetic |
| 867 | HAJBG14 | Cancer |
| 868 | HAJBV26 | Cancer |
| 869 | HAJBW16 | Immune/Hematopoetic, Neural/Sensory, Respiratory |
| 870 | HAJCL25 | Immune/Hematopoetic |
| 871 | HALAA60 | Cancer |
| 872 | HALSK07 | Cancer |
| 873 | HALSQ38 | Cancer |
| 874 | HALSQ59 | Cancer |
| 875 | HAMFE82 | Cancer |
| 876 | HAMFL84 | Cardiovascular, Digestive, Immune/Hematopoetic |
| 877 | HAMFP32 | Cancer |
| 878 | HAMFT10 | Cancer |
| 879 | HAMFY69 | Cancer |
| 880 | HAMGG89 | Immune/Hematopoetic, Neural/Sensory, Reproductive |
| 881 | HAMGO32 | Reproductive |

TABLE 1C-continued

| Gene No. | cDNA Clone ID: | Preferred Indications: |
|---|---|---|
| 882 | HAMGV47 | Cancer |
| 883 | HAMGW29 | Cancer |
| 884 | HAMHH20 | Cancer |
| 885 | HANGD45 | Musculoskeletal |
| 886 | HANGG89 | Cancer |
| 887 | HAOAB14 | Digestive, Musculoskeletal |
| 888 | HAOAB64 | Musculoskeletal, Reproductive |
| 889 | HAOST94 | Cancer |
| 890 | HAOTS04 | Reproductive |
| 891 | HAPAT76 | Cancer |
| 892 | HAPBL78 | Cancer |
| 893 | HAPNJ39 | Cancer |
| 894 | HAPNO80 | Cancer |
| 895 | HAPNZ94 | Cancer |
| 896 | HAPOC74 | Excretory, Immune/Hematopoetic, Reproductive |
| 897 | HAPOD80 | Cancer |
| 898 | HAPOF67 | Digestive, Excretory, Musculoskeletal |
| 899 | HAPOK30 | Reproductive |
| 900 | HAPOM45 | Cardiovascular, Digestive |
| 901 | HAPON17 | Cancer |
| 902 | HAPPS89 | Cancer |
| 903 | HAPQL38 | Cancer |
| 904 | HAPQQ94 | Immune/Hematopoetic, Reproductive |
| 905 | HAPRJ16 | Cancer |
| 906 | HAPRK85 | Cancer |
| 907 | HAPSA79 | Cancer |
| 908 | HAPSA79 | Cancer |
| 909 | HAPSO15 | Cancer |
| 910 | HAPSQ21 | Reproductive, Respiratory |
| 911 | HAPSR85 | Digestive, Endocrine |
| 912 | HAQAN31 | Cancer |
| 913 | HAQAR23 | Cancer |
| 914 | HAQBH57 | Cancer |
| 915 | HAQBI01 | Cancer |
| 916 | HAQBT52 | Digestive, Endocrine, Reproductive |
| 917 | HAQBZ15 | Cancer |
| 918 | HARAA15 | Neural/Sensory |
| 919 | HARAG28 | Neural/Sensory |
| 920 | HARAM05 | Neural/Sensory, Respiratory |
| 921 | HARAO44 | Neural/Sensory |
| 922 | HARAO 51 | Cancer |
| 923 | HARAY91 | Immune/Hematopoetic, Mixed Fetal, Neural/Sensory |
| 924 | HARBA09 | Cancer |
| 925 | HARMB79 | Cancer |
| 926 | HARMJ38 | Cancer |
| 927 | HARMS04 | Connective/Epithelial, Digestive |
| 928 | HARNB17 | Cancer |
| 929 | HARNB92 | Connective/Epithelial, Excretory, Immune/Hematopoetic |
| 930 | HASAU43 | Immune/Hematopoetic |
| 931 | HASAU84 | Cancer |
| 932 | HASAW52 | Cancer |
| 933 | HASMB80 | Cancer |
| 934 | HATAA15 | Cancer |
| 935 | HATCI19 | Endocrine, Immune/Hematopoetic, Reproductive |
| 936 | HATCI78 | Endocrine |
| 937 | HATCK44 | Endocrine, Immune/Hematopoetic, Reproductive |
| 938 | HATCM08 | Endocrine, Immune/Hematopoetic |
| 939 | HATCX80 | Cancer |
| 940 | HATDB65 | Endocrine, Reproductive, Respiratory |
| 941 | HATDL27 | Endocrine |
| 942 | HATDQ62 | Cancer |
| 943 | HATDZ29 | Endocrine |
| 944 | HATEF60 | Cancer |
| 945 | HATEI47 | Endocrine |
| 946 | HAUAE83 | Cancer |
| 947 | HAUAQ39 | Cancer |
| 948 | HAUAU73 | Cancer |
| 949 | HAVUR23 | Neural/Sensory |
| 950 | HAVVG36 | Cancer |
| 951 | HAWAT25 | Cancer |
| 952 | HAZAD32 | Cancer |
| 953 | HAZAP37 | Reproductive |
| 954 | HBAFA02 | Cancer |
| 955 | HBAFA04 | Cancer |
| 956 | HBAFQ54 | Cancer |
| 957 | HBAFZ29 | Cancer |
| 958 | HBAGD39 | Excretory, Reproductive |
| 959 | HBAGY25 | Cancer |
| 960 | HBAHA77 | Cancer |
| 961 | HBAMA40 | Excretory |
| 962 | HBBBC37 | Cancer |
| 963 | HBBBC71 | Cancer |
| 964 | HBCAY05 | Cancer |
| 965 | HBCAY27 | Immune/Hematopoetic, Neural/Sensory |
| 966 | HBCQL32 | Cancer |
| 967 | HBDAD07 | Immune/Hematopoetic |
| 968 | HBFMA07 | Cancer |
| 969 | HBFMC03 | Digestive, Musculoskeletal, Reproductive |
| 970 | HBGBA14 | Cancer |
| 971 | HBGNM47 | Cancer |
| 972 | HBGNP63 | Reproductive |
| 973 | HBGNQ12 | Cancer |
| 974 | HBHME51 | Reproductive, Respiratory |
| 975 | HBIAS26 | Cancer |
| 976 | HBIBF16 | Neural/Sensory |
| 977 | HBIBL04 | Cancer |
| 978 | HBIBU30 | Cancer |
| 979 | HBIBX03 | Cancer |
| 980 | HBIMF63 | Reproductive |
| 981 | HBIMT93 | Cancer |
| 982 | HBINK72 | Cancer |
| 983 | HBINU36 | Connective/Epithelial, Immune/Hematopoetic, Musculoskeletal |
| 984 | HBIOH81 | Cancer |
| 985 | HBJBQ35 | Immune/Hematopoetic |
| 986 | HBJCI95 | Cancer |
| 987 | HBJCK69 | Cancer |
| 988 | HBJEE48 | Cancer |
| 989 | HBJEL68 | Immune/Hematopoetic, Neural/Sensory |
| 990 | HBJES16 | Cancer |
| 991 | HBJEW84 | Immune/Hematopoetic |
| 992 | HBJFA56 | Cancer |
| 993 | HBJFE12 | Immune/Hematopoetic |
| 994 | HBJFJ26 | Cancer |
| 995 | HBJFM34 | Immune/Hematopoetic |
| 996 | HBJFV28 | Immune/Hematopoetic |
| 997 | HBJFX78 | Cancer |
| 998 | HBJHJ80 | Connective/Epithelial, Immune/Hematopoetic, Reproductive |
| 999 | HBJHO68 | Immune/Hematopoetic |
| 1000 | HBJHP03 | Immune/Hematopoetic, Reproductive |
| 1001 | HBJHZ58 | Immune/Hematopoetic, Reproductive, Respiratory |
| 1002 | HBJIO81 | Immune/Hematopoetic |
| 1003 | HBJIT60 | Immune/Hematopoetic |
| 1004 | HBJKC04 | Digestive, Immune/Hematopoetic |
| 1005 | HBJLD29 | Immune/Hematopoetic |
| 1006 | HBJLR70 | Immune/Hematopoetic, Neural/Sensory |
| 1007 | HBJMG49 | Immune/Hematopoetic |
| 1008 | HBJMX85 | Cancer |
| 1009 | HBJNB13 | Immune/Hematopoetic |
| 1010 | HBKED12 | Immune/Hematopoetic, Reproductive |
| 1011 | HBLKD56 | Musculoskeletal |
| 1012 | HBMBB80 | Digestive, Immune/Hematopoetic |
| 1013 | HBMCI50 | Immune/Hematopoetic |
| 1014 | HBMCJ42 | Immune/Hematopoetic, Reproductive |
| 1015 | HBMCL41 | Cancer |
| 1016 | HBMCT17 | Immune/Hematopoetic, Neural/Sensory |
| 1017 | HBMCU71 | Immune/Hematopoetic |
| 1018 | HBMDD55 | Immune/Hematopoetic |
| 1019 | HBMDK25 | Immune/Hematopoetic |
| 1020 | HBMSK09 | Digestive, Immune/Hematopoetic, Musculoskeletal |
| 1021 | HBMSN25 | Cancer |
| 1022 | HBMSO46 | Immune/Hematopoetic, Mixed Fetal, Reproductive |
| 1023 | HBMTA15 | Cancer |
| 1024 | HBMTD81 | Cancer |
| 1025 | HBMTV78 | Digestive, Immune/Hematopoetic |
| 1026 | HBMTY28 | Cancer |
| 1027 | HBMUT52 | Cancer |
| 1028 | HBMVI06 | Cancer |
| 1029 | HBMVI55 | Immune/Hematopoetic |
| 1030 | HBMVP04 | Cancer |

TABLE 1C-continued

| Gene No. | cDNA Clone ID: | Preferred Indications: |
|---|---|---|
| 1031 | HBMWB01 | Immune/Hematopoetic |
| 1032 | HBMWF85 | Cancer |
| 1033 | HBMXG32 | Immune/Hematopoetic |
| 1034 | HBMXN79 | Cancer |
| 1035 | HBMXP84 | Cancer |
| 1036 | HBNAF22 | Cancer |
| 1037 | HBNAJ22 | Cancer |
| 1038 | HBNAU27 | Cancer |
| 1039 | HBNAV22 | Digestive, Reproductive |
| 1040 | HBNBE21 | Cancer |
| 1041 | HBNBG49 | Cancer |
| 1042 | HBNBL77 | Cancer |
| 1043 | HBNBQ61 | Reproductive |
| 1044 | HBODE48 | Digestive, Excretory, Immune/Hematopoetic |
| 1045 | HBODQ16 | Cancer |
| 1046 | HBQAA49 | Neural/Sensory |
| 1047 | HBQAB27 | Endocrine, Neural/Sensory |
| 1048 | HBQAB44 | Neural/Sensory, Reproductive, Respiratory |
| 1049 | HBQAE92 | Cancer |
| 1050 | HBSAJ16 | Connective/Epithelial, Musculoskeletal, Reproductive |
| 1051 | HBWBR94 | Neural/Sensory |
| 1052 | HBWBX21 | Immune/Hematopoetic, Neural/Sensory |
| 1053 | HBWCB95 | Neural/Sensory |
| 1054 | HBWCF75 | Neural/Sensory |
| 1055 | HBWCM83 | Digestive, Immune/Hematopoetic, Neural/Sensory |
| 1056 | HBXAB02 | Cancer |
| 1057 | HBXAM53 | Cancer |
| 1058 | HBXCF95 | Cancer |
| 1059 | HBXCL50 | Digestive, Excretory, Neural/Sensory |
| 1060 | HBXCL93 | Neural/Sensory, Reproductive |
| 1061 | HBXCT44 | Cancer |
| 1062 | HBXDC63 | Neural/Sensory |
| 1063 | HBXED80 | Immune/Hematopoetic, Neural/Sensory |
| 1064 | HBXFC78 | Cancer |
| 1065 | HBXFG80 | Cancer |
| 1066 | HBXFP23 | Cancer |
| 1067 | HBXFR04 | Neural/Sensory |
| 1068 | HBXFZ38 | Cancer |
| 1069 | HBXGH74 | Neural/Sensory |
| 1070 | HBXGI20 | Cancer |
| 1071 | HBXGK12 | Cancer |
| 1072 | HBXGM67 | Neural/Sensory |
| 1073 | HBXGP60 | Cancer |
| 1074 | HBXGP76 | Immune/Hematopoetic, Neural/Sensory |
| 1075 | HBZAI19 | Immune/Hematopoetic, Reproductive |
| 1076 | HBZAI90 | Immune/Hematopoetic, Reproductive |
| 1077 | HBZAJ83 | Reproductive |
| 1078 | HCABR41 | Cancer |
| 1079 | HCABW07 | Cancer |
| 1080 | HCACJ81 | Cancer |
| 1081 | HCACY32 | Cancer |
| 1082 | HCBND16 | Digestive, Musculoskeletal, Reproductive |
| 1083 | HCCCG83 | Cancer |
| 1084 | HCDAF84 | Musculoskeletal |
| 1085 | HCDAN25 | Cancer |
| 1086 | HCDAR68 | Cancer |
| 1087 | HCDAT43 | Cancer |
| 1088 | HCDBO20 | Musculoskeletal, Respiratory |
| 1089 | HCDBP36 | Digestive, Musculoskeletal |
| 1090 | HCDCF30 | Cancer |
| 1091 | HCDDB78 | Cancer |
| 1092 | HCDDP40 | Immune/Hematopoetic, Musculoskeletal |
| 1093 | HCDDR90 | Cancer |
| 1094 | HCDEJ37 | Immune/Hematopoetic, Musculoskeletal |
| 1095 | HCDEO95 | Cancer |
| 1096 | HCE1P80 | Cancer |
| 1097 | HCE1Q30 | Immune/Hematopoetic, Neural/Sensory |
| 1098 | HCE1X60 | Neural/Sensory |
| 1099 | HCE2B33 | Cancer |
| 1100 | HCE2P86 | Cancer |
| 1101 | HCE2W56 | Cancer |
| 1102 | HCE3C52 | Cancer |
| 1103 | HCE3F11 | Digestive, Neural/Sensory |
| 1104 | HCE3F70 | Cancer |
| 1105 | HCE3G20 | Cancer |
| 1106 | HCE3J79 | Cancer |
| 1107 | HCE3L18 | Neural/Sensory |
| 1108 | HCE3Q10 | Cancer |
| 1109 | HCE3T57 | Cancer |
| 1110 | HCE3Z39 | Cancer |
| 1111 | HCE3Z61 | Cancer |
| 1112 | HCE4G61 | Cancer |
| 1113 | HCE4L28 | Cancer |
| 1114 | HCE4Y07 | Cancer |
| 1115 | HCE5B20 | Mixed Fetal, Neural/Sensory |
| 1116 | HCE5G23 | Cancer |
| 1117 | HCE5M29 | Cancer |
| 1118 | HCEAB46 | Cancer |
| 1119 | HCEBA03 | Neural/Sensory |
| 1120 | HCEBC76 | Neural/Sensory |
| 1121 | HCEBC87 | Cancer |
| 1122 | HCEBF19 | Cancer |
| 1123 | HCEBN44 | Neural/Sensory |
| 1124 | HCEBR71 | Neural/Sensory |
| 1125 | HCECA49 | Cancer |
| 1126 | HCECN54 | Excretory, Neural/Sensory |
| 1127 | HCEDH38 | Mixed Fetal, Neural/Sensory |
| 1128 | HCEDH81 | Cancer |
| 1129 | HCEDO21 | Neural/Sensory |
| 1130 | HCEDO84 | Cancer |
| 1131 | HCEEC15 | Cancer |
| 1132 | HCEEF50 | Cardiovascular, Neural/Sensory |
| 1133 | HCEEK50 | Cancer |
| 1134 | HCEEM18 | Cancer |
| 1135 | HCEES64 | Neural/Sensory |
| 1136 | HCEES66 | Digestive, Neural/Sensory |
| 1137 | HCEFB70 | Neural/Sensory |
| 1138 | HCEFE96 | Cancer |
| 1139 | HCEFI77 | Neural/Sensory |
| 1140 | HCEFZ05 | Digestive, Mixed Fetal, Neural/Sensory |
| 1141 | HCEIA77 | Cancer |
| 1142 | HCEIE80 | Cancer |
| 1143 | HCEIF12 | Cancer |
| 1144 | HCEJG71 | Cancer |
| 1145 | HCEJP80 | Neural/Sensory |
| 1146 | HCEJQ69 | Cancer |
| 1147 | HCELE47 | Cancer |
| 1148 | HCEMD38 | Connective/Epithelial, Neural/Sensory |
| 1149 | HCEMU42 | Cancer |
| 1150 | HCENE16 | Cancer |
| 1151 | HCEOC41 | Cancer |
| 1152 | HCEOR67 | Neural/Sensory |
| 1153 | HCEPE30 | Excretory, Neural/Sensory |
| 1154 | HCEPF19 | Cancer |
| 1155 | HCEQA68 | Neural/Sensory |
| 1156 | HCESA34 | Cancer |
| 1157 | HCESF40 | Immune/Hematopoetic, Neural/Sensory |
| 1158 | HCEVB07 | Cancer |
| 1159 | HCEVB32 | Cancer |
| 1160 | HCEVB76 | Cancer |
| 1161 | HCEVF30 | Cancer |
| 1162 | HCEVR60 | Cancer |
| 1163 | HCEZR26 | Cancer |
| 1164 | HCEZS40 | Cancer |
| 1165 | HCFAD33 | Cancer |
| 1166 | HCFBH15 | Immune/Hematopoetic |
| 1167 | HCFBJ91 | Immune/Hematopoetic |
| 1168 | HCFBL76 | Cancer |
| 1169 | HCFBM53 | Cancer |
| 1170 | HCFBQ81 | Immune/Hematopoetic |
| 1171 | HCFCC07 | Digestive, Immune/Hematopoetic |
| 1172 | HCFCE10 | Cancer |
| 1173 | HCFCI07 | Immune/Hematopoetic |
| 1174 | HCFDD76 | Immune/Hematopoetic |
| 1175 | HCFLD84 | Cancer |
| 1176 | HCFLQ84 | Cancer |
| 1177 | HCFLR78 | Cancer |
| 1178 | HCFLS78 | Cancer |
| 1179 | HCFMJ81 | Cancer |
| 1180 | HCFMM26 | Immune/Hematopoetic |
| 1181 | HCFMS95 | Cancer |

TABLE 1C-continued

| Gene No. | cDNA Clone ID: | Preferred Indications: |
|---|---|---|
| 1182 | HCFMV39 | Cancer |
| 1183 | HCFMX35 | Immune/Hematopoetic |
| 1184 | HCFMX95 | Immune/Hematopoetic |
| 1185 | HCFNC26 | Immune/Hematopoetic |
| 1186 | HCFNF11 | Cancer |
| 1187 | HCFNK47 | Cancer |
| 1188 | HCFNN16 | Cancer |
| 1189 | HCFOG45 | Cancer |
| 1190 | HCGAD44 | Cancer |
| 1191 | HCGBE81 | Cancer |
| 1192 | HCGMF16 | Cancer |
| 1193 | HCHAA63 | Cancer |
| 1194 | HCHAR28 | Cancer |
| 1195 | HCHAR90 | Cancer |
| 1196 | HCHCF61 | Reproductive |
| 1197 | HCHMX01 | Cancer |
| 1198 | HCHNT03 | Digestive, Reproductive |
| 1199 | HCHPF68 | Cancer |
| 1200 | HCHPU32 | Cancer |
| 1201 | HCLBW50 | Cancer |
| 1202 | HCLCJ15 | Cancer |
| 1203 | HCLCW50 | Respiratory |
| 1204 | HCMSC92 | Cancer |
| 1205 | HCMSS06 | Cancer |
| 1206 | HCMSW93 | Cancer |
| 1207 | HCMSX86 | Cancer |
| 1208 | HCNAH57 | Digestive |
| 1209 | HCNAP62 | Cancer |
| 1210 | HCNAV36 | Cancer |
| 1211 | HCNDA61 | Cancer |
| 1212 | HCNDV12 | Digestive, Reproductive |
| 1213 | HCNSB01 | Cancer |
| 1214 | HCNSD76 | Digestive |
| 1215 | HCNSP40 | Cancer |
| 1216 | HCOMM91 | Cancer |
| 1217 | HCOPG62 | Cancer |
| 1218 | HCPAA69 | Neural/Sensory |
| 1219 | HCQAI40 | Digestive, Immune/Hematopoetic, Reproductive |
| 1220 | HCQAM33 | Musculoskeletal, Reproductive |
| 1221 | HCQCF36 | Digestive, Immune/Hematopoetic |
| 1222 | HCQDE22 | Digestive |
| 1223 | HCRAF32 | Neural/Sensory |
| 1224 | HCRAI47 | Cancer |
| 1225 | HCRBL20 | Cancer |
| 1226 | HCRBR74 | Cancer |
| 1227 | HCRME12 | Cancer |
| 1228 | HCRMZ90 | Cancer |
| 1229 | HCRNC80 | Cancer |
| 1230 | HCRNF14 | Cancer |
| 1231 | HCRNO87 | Cancer |
| 1232 | HCRNU76 | Cancer |
| 1233 | HCRPV17 | Cancer |
| 1234 | HCUAQ30 | Immune/Hematopoetic |
| 1235 | HCUBF15 | Immune/Hematopoetic |
| 1236 | HCUBL62 | Immune/Hematopoetic |
| 1237 | HCUBN59 | Immune/Hematopoetic |
| 1238 | HCUBN71 | Immune/Hematopoetic, Reproductive |
| 1239 | HCUBV79 | Immune/Hematopoetic, Neural/Sensory |
| 1240 | HCUBW95 | Immune/Hematopoetic, Neural/Sensory |
| 1241 | HCUDB38 | Immune/Hematopoetic |
| 1242 | HCUDC07 | Immune/Hematopoetic |
| 1243 | HCUDD24 | Digestive, Immune/Hematopoetic, Reproductive |
| 1244 | HCUDE16 | Cancer |
| 1245 | HCUDK80 | Immune/Hematopoetic |
| 1246 | HCUDW10 | Cancer |
| 1247 | HCUEN88 | Immune/Hematopoetic |
| 1248 | HCUEP91 | Immune/Hematopoetic |
| 1249 | HCJFX40 | Immune/Hematopoetic |
| 1250 | HCUFZ62 | Immune/Hematopoetic |
| 1251 | HCUGC55 | Immune/Hematopoetic |
| 1252 | HCUGE72 | Cancer |
| 1253 | HCUGO12 | Digestive, Immune/Hematopoetic, Mixed Fetal |
| 1254 | HCUHF89 | Cancer |
| 1255 | HCUHL13 | Immune/Hematopoetic |
| 1256 | HCUHQ40 | Cancer |
| 1257 | HCUIN80 | Immune/Hematopoetic |
| 1258 | HCUIO20 | Immune/Hematopoetic |
| 1259 | HCWAG01 | Cancer |
| 1260 | HCWAU23 | Immune/Hematopoetic |
| 1261 | HCWBB42 | Immune/Hematopoetic |
| 1262 | HCWBE20 | Immune/Hematopoetic |
| 1263 | HCWBE22 | Immune/Hematopoetic, Neural/Sensory |
| 1264 | HCWBP34 | Immune/Hematopoetic |
| 1265 | HCWBU94 | Immune/Hematopoetic |
| 1266 | HCWCH14 | Immune/Hematopoetic |
| 1267 | HCWCT62 | Immune/Hematopoetic |
| 1268 | HCWDE90 | Immune/Hematopoetic |
| 1269 | HCWDL75 | Cardiovascular, Immune/Hematopoetic |
| 1270 | HCWDV84 | Immune/Hematopoetic |
| 1271 | HCWDY64 | Excretory, Immune/Hematopoetic |
| 1272 | HCWEM59 | Immune/Hematopoetic |
| 1273 | HCWFL55 | Immune/Hematopoetic |
| 1274 | HCWFT79 | Immune/Hematopoetic |
| 1275 | HCWFU77 | Cancer |
| 1276 | HCWFV11 | Immune/Hematopoetic |
| 1277 | HCWFZ59 | Immune/Hematopoetic |
| 1278 | HCWHN10 | Immune/Hematopoetic |
| 1279 | HCWHP79 | Immune/Hematopoetic |
| 1280 | HCWHT35 | Immune/Hematopoetic |
| 1281 | HCWHV88 | Cancer |
| 1282 | HCWHX82 | Immune/Hematopoetic, Neural/Sensory |
| 1283 | HCWHZ24 | Immune/Hematopoetic |
| 1284 | HCWHZ93 | Immune/Hematopoetic, Neural/Sensory |
| 1285 | HCWKR01 | Cancer |
| 1286 | HCWUA22 | Immune/Hematopoetic |
| 1287 | HCWUI05 | Immune/Hematopoetic |
| 1288 | HCWUI13 | Immune/Hematopoetic |
| 1289 | HCYBG92 | Cancer |
| 1290 | HCYBI36 | Cancer |
| 1291 | HCYBI36 | Cancer |
| 1292 | HCYBI42 | Digestive, Reproductive |
| 1293 | HCYBN55 | Cancer |
| 1294 | HDAAC10 | Cardiovascular, Digestive, Reproductive |
| 1295 | HDABU01 | Neural/Sensory |
| 1296 | HDABV82 | Cancer |
| 1297 | HDDMW90 | Cancer |
| 1298 | HDFQB14 | Immune/Hematopoetic, Neural/Sensory, Reproductive |
| 1299 | HDHMB42 | Cancer |
| 1300 | HDLAG89 | Cancer |
| 1301 | HDLAY18 | Cancer |
| 1302 | HDPAE76 | Cancer |
| 1303 | HDPAJ93 | Cancer |
| 1304 | HDPAP35 | Excretory, Immune/Hematopoetic, Neural/Sensory |
| 1305 | HDPAQ55 | Digestive, Immune/Hematopoetic, Reproductive |
| 1306 | HDPAS92 | Cancer |
| 1307 | HDPAU16 | Cancer |
| 1308 | HDPAW44 | Cancer |
| 1309 | HDPBA48 | Immune/Hematopoetic |
| 1310 | HDPBN34 | Immune/Hematopoetic |
| 1311 | HDPBO81 | Digestive, Immune/Hematopoetic, Reproductive |
| 1312 | HDPBW68 | Cancer |
| 1313 | HDPCJ43 | Cancer |
| 1314 | HDPCL05 | Immune/Hematopoetic |
| 1315 | HDPCM26 | Cancer |
| 1316 | HDPDD03 | Cancer |
| 1317 | HDPDI45 | Cancer |
| 1318 | HDPDI66 | Cancer |
| 1319 | HDPFB02 | Cancer |
| 1320 | HDPFY41 | Cancer |
| 1321 | HDPGE10 | Immune/Hematopoetic |
| 1322 | HDPGT25 | Cancer |
| 1323 | HDPHH40 | Cancer |
| 1324 | HDPIE85 | Cancer |
| 1325 | HDPIO09 | Cancer |
| 1326 | HDPIO54 | Immune/Hematopoetic, Reproductive |
| 1327 | HDPIW06 | Digestive, Immune/Hematopoetic, Neural/Sensory |
| 1328 | HDPKB18 | Immune/Hematopoetic |
| 1329 | HDPKI93 | Cancer |
| 1330 | HDPLO25 | Cancer |
| 1331 | HDPLV95 | Immune/Hematopoetic, Reproductive |
| 1332 | HDPMA04 | Immune/Hematopoetic |
| 1333 | HDPML23 | Immune/Hematopoetic, Neural/Sensory |

TABLE 1C-continued

| Gene No. | cDNA Clone ID: | Preferred Indications: |
|---|---|---|
| 1334 | HDPMM88 | Cancer |
| 1335 | HDPMS12 | Cancer |
| 1336 | HDPMV72 | Immune/Hematopoetic |
| 1337 | HDPND68 | Cancer |
| 1338 | HDPOR60 | Cancer |
| 1339 | HDPOW86 | Cancer |
| 1340 | HDPPJ60 | Cancer |
| 1341 | HDPQN11 | Cancer |
| 1342 | HDPQN12 | Cancer |
| 1343 | HDPQV66 | Immune/Hematopoetic |
| 1344 | HDPRH52 | Cancer |
| 1345 | HDPRJ60 | Cancer |
| 1346 | HDPRK33 | Immune/Hematopoetic, Mixed Fetal |
| 1347 | HDPRN70 | Immune/Hematopoetic |
| 1348 | HDPRX82 | Cancer |
| 1349 | HDPSB01 | Cancer |
| 1350 | HDPTC31 | Immune/Hematopoetic |
| 1351 | HDPTM61 | Digestive, Immune/Hematopoetic |
| 1352 | HDPTQ73 | Cancer |
| 1353 | HDPTW24 | Immune/Hematopoetic |
| 1354 | HDPTW65 | Excretory |
| 1355 | HDPVW11 | Cancer |
| 1356 | HDPWP69 | Cancer |
| 1357 | HDPXL05 | Immune/Hematopoetic, Reproductive |
| 1358 | HDPXQ54 | Cardiovascular, Connective/Epithelial, Immune/Hematopoetic |
| 1359 | HDPXR23 | Digestive, Immune/Hematopoetic |
| 1360 | HDPXY88 | Cancer |
| 1361 | HDPYE41 | Immune/Hematopoetic |
| 1362 | HDQFN31 | Cancer |
| 1363 | HDQFN60 | Cancer |
| 1364 | HDQFU27 | Cancer |
| 1365 | HDQFU73 | Digestive, Immune/Hematopoetic |
| 1366 | HDQGO29 | Immune/Hematopoetic |
| 1367 | HDQGY41 | Cancer |
| 1368 | HDQHC29 | Cancer |
| 1369 | HDQHO40 | Cancer |
| 1370 | HDQHQ91 | Cancer |
| 1371 | HDQHY04 | Cancer |
| 1372 | HDQIH54 | Immune/Hematopoetic |
| 1373 | HDRMB11 | Digestive |
| 1374 | HDRMF68 | Digestive, Respiratory |
| 1375 | HDRMI82 | Cancer |
| 1376 | HDSAG91 | Immune/Hematopoetic |
| 1377 | HDSAP81 | Cancer |
| 1378 | HDSAP92 | Cancer |
| 1379 | HDTAB05 | Cancer |
| 1380 | HDTAB58 | Cancer |
| 1381 | HDTAE40 | Digestive, Immune/Hematopoetic |
| 1382 | HDTAQ57 | Connective/Epithelial, Immune/Hematopoetic, Reproductive |
| 1383 | HDTAR06 | Cancer |
| 1384 | HDTAT90 | Cancer |
| 1385 | HDTAV25 | Cancer |
| 1386 | HDTAW95 | Cancer |
| 1387 | HDTAY29 | Cancer |
| 1388 | HDTBP51 | Digestive, Immune/Hematopoetic, Reproductive |
| 1389 | HDTBW53 | Cancer |
| 1390 | HDTDC56 | Cancer |
| 1391 | HDTDM65 | Cancer |
| 1392 | HDTDT55 | Cancer |
| 1393 | HDTDZ50 | Cancer |
| 1394 | HDTGC86 | Digestive, Immune/Hematopoetic, Reproductive |
| 1395 | HDTII23 | Immune/Hematopoetic |
| 1396 | HDTJG33 | Cancer |
| 1397 | HDTKS69 | Cancer |
| 1398 | HDTLR06 | Cancer |
| 1399 | HDUAC77 | Immune/Hematopoetic, Mixed Fetal, Neural/Sensory |
| 1400 | HE2AA26 | Mixed Fetal |
| 1401 | HE2AF21 | Mixed Fetal |
| 1402 | HE2AG50 | Cancer |
| 1403 | HE2AT09 | Cancer |
| 1404 | HE2AV74 | Cancer |
| 1405 | HE2AX96 | Mixed Fetal |
| 1406 | HE2AY71 | Cancer |
| 1407 | HE2BX71 | Cancer |
| 1408 | HE2CT29 | Mixed Fetal |
| 1409 | HE2DC87 | Mixed Fetal |
| 1410 | HE2EC79 | Connective/Epithelial, Mixed Fetal, Neural/Sensory |
| 1411 | HE2EO70 | Mixed Fetal, Neural/Sensory |
| 1412 | HE2ES51 | Cancer |
| 1413 | HE2FB90 | Cancer |
| 1414 | HE2FC81 | Mixed Fetal |
| 1415 | HE2FE45 | Cancer |
| 1416 | HE2FE69 | Cancer |
| 1417 | HE2FI45 | Cancer |
| 1418 | HE2FL70 | Immune/Hematopoetic, Mixed Fetal, Neural/Sensory |
| 1419 | HE2GS36 | Digestive, Mixed Fetal, Reproductive |
| 1420 | HE2GT20 | Cancer |
| 1421 | HE2ID06 | Cancer |
| 1422 | HE2KK74 | Cancer |
| 1423 | HE2LW65 | Cancer |
| 1424 | HE2NR62 | Cancer |
| 1425 | HE2OF09 | Cancer |
| 1426 | HE2OO64 | Cancer |
| 1427 | HE2OW03 | Immune/Hematopoetic, Mixed Fetal |
| 1428 | HE2PI29 | Cancer |
| 1429 | HE2PO86 | Cancer |
| 1430 | HE2RN91 | Cancer |
| 1431 | HE2RO22 | Mixed Fetal |
| 1432 | HE2SI26 | Cancer |
| 1433 | HE6AJ31 | Mixed Fetal |
| 1434 | HE6CL49 | Mixed Fetal |
| 1435 | HE6CT22 | Mixed Fetal, Reproductive |
| 1436 | HE6CT56 | Mixed Fetal, Neural/Sensory |
| 1437 | HE6CY88 | Mixed Fetal |
| 1438 | HE6EL90 | Cancer |
| 1439 | HE6FB81 | Mixed Fetal |
| 1440 | HE6GA29 | Mixed Fetal |
| 1441 | HE6GE84 | Mixed Fetal |
| 1442 | HE6GL64 | Cardiovascular, Immune/Hematopoetic, Mixed Fetal |
| 1443 | HE6GR02 | Immune/Hematopoetic, Mixed Fetal |
| 1444 | HE7TF86 | Cancer |
| 1445 | HE7TM22 | Mixed Fetal |
| 1446 | HE8AO36 | Mixed Fetal |
| 1447 | HE8CH92 | Cancer |
| 1448 | HE8CV18 | Cancer |
| 1449 | HE8DG53 | Cancer |
| 1450 | HE8DR25 | Excretory, Mixed Fetal, Neural/Sensory |
| 1451 | HE8DX88 | Mixed Fetal |
| 1452 | HE8DY08 | Cancer |
| 1453 | HE8EF43 | Cancer |
| 1454 | HE8EM69 | Cancer |
| 1455 | HE8ER60 | Cancer |
| 1456 | HE8EU04 | Cancer |
| 1457 | HE8EV15 | Mixed Fetal |
| 1458 | HE8EW79 | Cancer |
| 1459 | HE8EY43 | Cancer |
| 1460 | HE8EZ48 | Cancer |
| 1461 | HE8FD93 | Cancer |
| 1462 | HE8FK78 | Cancer |
| 1463 | HE8MG65 | Cancer |
| 1464 | HE8MG70 | Mixed Fetal, Neural/Sensory |
| 1465 | HE8MH77 | Immune/Hematopoetic, Mixed Fetal, Neural/Sensory |
| 1466 | HE8ND56 | Cancer |
| 1467 | HE8NG02 | Mixed Fetal, Reproductive |
| 1468 | HE8NQ42 | Mixed Fetal |
| 1469 | HE8OK73 | Mixed Fetal, Neural/Sensory |
| 1470 | HE8PW38 | Mixed Fetal, Neural/Sensory, Reproductive |
| 1471 | HE8QD31 | Digestive, Mixed Fetal, Neural/Sensory |
| 1472 | HE8QG24 | Cancer |
| 1473 | HE8QO53 | Cancer |
| 1474 | HE8QT72 | Mixed Fetal |
| 1475 | HE8QV43 | Cancer |
| 1476 | HE8SE91 | Cancer |
| 1477 | HE8TB68 | Cancer |
| 1478 | HE8TY90 | Cancer |
| 1479 | HE8UT25 | Mixed Fetal |
| 1480 | HE8UY36 | Cancer |
| 1481 | HE9AN21 | Mixed Fetal, Neural/Sensory |
| 1482 | HE9CS37 | Cancer |
| 1483 | HE9FB42 | Cancer |

TABLE 1C-continued

| Gene No. | cDNA Clone ID: | Preferred Indications: |
|---|---|---|
| 1484 | HE9FC17 | Cancer |
| 1485 | HE9FE83 | Immune/Hematopoetic, Mixed Fetal, Musculoskeletal |
| 1486 | HE9FT63 | Cancer |
| 1487 | HE9HU17 | Cancer |
| 1488 | HE9HW52 | Cancer |
| 1489 | HE9MI43 | Cancer |
| 1490 | HE9NB19 | Immune/Hematopoetic, Mixed Fetal, Reproductive |
| 1491 | HE9ND27 | Cancer |
| 1492 | HE9ND43 | Cancer |
| 1493 | HE9ND48 | Mixed Fetal |
| 1494 | HE9NH44 | Cancer |
| 1495 | HE9NN84 | Cancer |
| 1496 | HE9PF45 | Cancer |
| 1497 | HE9PM90 | Cancer |
| 1498 | HE9PR39 | Digestive, Mixed Fetal, Musculoskeletal |
| 1499 | HE9QN39 | Cancer |
| 1500 | HE9RJ42 | Mixed Fetal |
| 1501 | HE9RO27 | Connective/Epithelial, Mixed Fetal |
| 1502 | HE9RO44 | Immune/Hematopoetic, Mixed Fetal |
| 1503 | HE9SE18 | Digestive |
| 1504 | HE9TH18 | Cancer |
| 1505 | HEAAH81 | Cancer |
| 1506 | HEAAJ57 | Immune/Hematopoetic, Reproductive |
| 1507 | HEAAX57 | Reproductive |
| 1508 | HEBAH57 | Neural/Sensory |
| 1509 | HEBAL06 | Neural/Sensory, Reproductive |
| 1510 | HEBBW11 | Cancer |
| 1511 | HEBCM27 | Cancer |
| 1512 | HEBDF05 | Neural/Sensory |
| 1513 | HEBFI91 | Neural/Sensory |
| 1514 | HEBFL88 | Neural/Sensory |
| 1515 | HEBFT20 | Neural/Sensory |
| 1516 | HEBGF73 | Cancer |
| 1517 | HEEAA16 | Cancer |
| 1518 | HEEAG84 | Reproductive |
| 1519 | HEEAG93 | Cancer |
| 1520 | HEEAM62 | Excretory, Reproductive |
| 1521 | HEEAZ65 | Musculoskeletal, Reproductive |
| 1522 | HEEBB55 | Cancer |
| 1523 | HEEBI05 | Digestive, Reproductive |
| 1524 | HEGAI91 | Reproductive |
| 1525 | HEGAK23 | Cancer |
| 1526 | HEGAK44 | Cancer |
| 1527 | HEGAK44 | Cancer |
| 1528 | HEGAL46 | Cancer |
| 1529 | HEGCL11 | Cardiovascular, Immune/Hematopoetic, Reproductive |
| 1530 | HEIAB33 | Cardiovascular, Digestive, Immune/Hematopoetic |
| 1531 | HEJAC52 | Cancer |
| 1532 | HEIAU93 | Immune/Hematopoetic |
| 1533 | HELAW45 | Cardiovascular |
| 1534 | HELBA06 | Cancer |
| 1535 | HELBC12 | Cancer |
| 1536 | HELBU29 | Cancer |
| 1537 | HELBW38 | Cancer |
| 1538 | HELDL29 | Cardiovascular |
| 1539 | HELDY05 | Cancer |
| 1540 | HELDY41 | Cancer |
| 1541 | HELDY74 | Cancer |
| 1542 | HELDZ32 | Cancer |
| 1543 | HELFQ07 | Cancer |
| 1544 | HELGF34 | Cancer |
| 1545 | HELHD64 | Cancer |
| 1546 | HELHN47 | Cancer |
| 1547 | HELHN47 | Cancer |
| 1548 | HEMAE80 | Cardiovascular, Musculoskeletal, Reproductive |
| 1549 | HEMCM42 | Cancer |
| 1550 | HEMCV19 | Cancer |
| 1551 | HEMDX17 | Cardiovascular |
| 1552 | HEMFA84 | Cancer |
| 1553 | HEMFQ46 | Cancer |
| 1554 | HEMFS60 | Cancer |
| 1555 | HEMGB12 | Cancer |
| 1556 | HEMGD15 | Cancer |
| 1557 | HEOMG13 | Digestive, Immune/Hematopoetic, Reproductive |
| 1558 | HEOMQ62 | Cancer |
| 1559 | HEOMR73 | Immune/Hematopoetic |
| 1560 | HEOMW84 | ConnectivefEpithelial, Immune/Hematopoetic |
| 1561 | HEOMX53 | Digestive, Immune/Hematopoetic, Neural/Sensory |
| 1562 | HEONC95 | Cancer |
| 1563 | HEONM66 | Immune/Hematopoetic |
| 1564 | HEONP72 | Cancer |
| 1565 | HEONX38 | Cancer |
| 1566 | HEOOV79 | Cancer |
| 1567 | HEOQX60 | Cancer |
| 1568 | HEPBC02 | Cancer |
| 1569 | HEPCE18 | Cancer |
| 1570 | HEPCE37 | Reproductive |
| 1571 | HEPCU48 | Cancer |
| 1572 | HEQAF19 | Cancer |
| 1573 | HEQAG39 | Cancer |
| 1574 | HEQAO65 | Cancer |
| 1575 | HEQBF32 | Cardiovascular, Neural/Sensory, Reproductive |
| 1576 | HEQBH65 | Immune/Hematopoetic, Reproductive |
| 1577 | HEQBR95 | Cancer |
| 1578 | HEQBU15 | Cancer |
| 1579 | HERAG83 | Connective/Epithelial |
| 1580 | HERAH36 | Connective/Epithelial |
| 1581 | HERAM05 | Connective/Epithelial, Immune/Hematopoetic |
| 1582 | HERAN54 | Connective/Epithelial |
| 1583 | HERAN63 | Connective/Epithelial, Reproductive |
| 1584 | HESAL35 | Connective/Epithelial, Mixed Fetal |
| 1585 | HETAD68 | Cancer |
| 1586 | HETAM53 | Cancer |
| 1587 | HETAR42 | Cancer |
| 1588 | HETAR54 | Cancer |
| 1589 | HETAY39 | Cancer |
| 1590 | HETBA14 | Cancer |
| 1591 | HETBB70 | Immune/Hematopoetic, Reproductive |
| 1592 | HETBX14 | Cancer |
| 1593 | HETCL11 | Cancer |
| 1594 | HETCO02 | Immune/Hematopoetic, Reproductive |
| 1595 | HETCP58 | Reproductive |
| 1596 | HETDB76 | Musculoskeletal, Reproductive |
| 1597 | HETDE26 | Cancer |
| 1598 | HETDM20 | Cancer |
| 1599 | HETDT81 | Digestive, Immune/Hematopoetic, Reproductive |
| 1600 | HETEQ88 | Cancer |
| 1601 | HETEW02 | Cancer |
| 1602 | HETFI51 | Reproductive |
| 1603 | HETFJ05 | Cancer |
| 1604 | HETHE81 | Cancer |
| 1605 | HETHN28 | Cancer |
| 1606 | HETHO95 | Cancer |
| 1607 | HETHR73 | Cancer |
| 1608 | HETHW90 | Cancer |
| 1609 | HETIB83 | Cancer |
| 1610 | HETJZ45 | Cancer |
| 1611 | HETKD92 | Cancer |
| 1612 | HETKL27 | Cancer |
| 1613 | HETLT82 | Immune/Hematopoetic, Reproductive |
| 1614 | HFAAH18 | Connective/Epithelial, Neural/Sensory |
| 1615 | HFACJ31 | Neural/Sensory |
| 1616 | HFADD53 | Cancer |
| 1617 | HFADF37 | Cancer |
| 1618 | HFAME37 | Neural/Sensory |
| 1619 | HFAUO78 | Cancer |
| 1620 | HFCAA91 | Neural/Sensory |
| 1621 | HFCAL39 | Cancer |
| 1622 | HFCBD73 | Cancer |
| 1623 | HFCCU63 | Neural/Sensory |
| 1624 | HFCDR13 | Neural/Sensory |
| 1625 | HFCDV54 | Cancer |
| 1626 | HFCDW34 | Cancer |
| 1627 | HFCDW42 | Cancer |
| 1628 | HFCED59 | Immune/Hematopoetic, Neural/Sensory |
| 1629 | HFCEP45 | Neural/Sensory |
| 1630 | HFCEW05 | Cardiovascular, Neural/Sensory |
| 1631 | HFCEW42 | Neural/Sensory |
| 1632 | HFCFJ18 | Cancer |
| 1633 | HFCFJ18 | Cancer |
| 1634 | HFEAF41 | Connective/Epithelial, Digestive |
| 1635 | HFEAN33 | Cancer |

TABLE 1C-continued

| Gene No. | cDNA Clone ID: | Preferred Indications: |
|---|---|---|
| 1636 | HFEAN33 | Cancer |
| 1637 | HFEAT91 | Connective/Epithelial, Immune/Hematopoetic |
| 1638 | HFEBA88 | Cancer |
| 1639 | HFEBE12 | Cancer |
| 1640 | HFEBF41 | Cancer |
| 1641 | HFEBH21 | Connective/Epithelial, Reproductive |
| 1642 | HFEBP27 | Cancer |
| 1643 | HFEBV76 | Cancer |
| 1644 | HFFAE91 | Neural/Sensory |
| 1645 | HFFAK76 | Neural/Sensory, Reproductive |
| 1646 | HFFAT33 | Cancer |
| 1647 | HFGAB48 | Digestive, Neural/Sensory |
| 1648 | HFGAB89 | Cancer |
| 1649 | HFGAG96 | Cancer |
| 1650 | HFGAH44 | Cancer |
| 1651 | HFGAL10 | Neural/Sensory |
| 1652 | HFIAB31 | Cancer |
| 1653 | HFIAP16 | Musculoskeletal |
| 1654 | HFIAX46 | Cardiovascular, Musculoskeletal |
| 1655 | HFIBV09 | Cancer |
| 1656 | HFICL62 | Cancer |
| 1657 | HFICR14 | Cancer |
| 1658 | HFIDQ92 | Cancer |
| 1659 | HFIDS78 | Connective/Epithelial, Digestive, Musculoskeletal |
| 1660 | HFIHO70 | Cancer |
| 1661 | HFIHQ89 | Cardiovascular, Connective/Epithelial, Musculoskeletal |
| 1662 | HFIHZ96 | Musculoskeletal |
| 1663 | HFITF82 | Immune/Hematopoetic, Musculoskeletal |
| 1664 | HFIUE67 | Cancer |
| 1665 | HFIUE82 | Cancer |
| 1666 | HFIUM15 | Cancer |
| 1667 | HFIUP37 | Musculoskeletal |
| 1668 | HFIUR35 | Musculoskeletal |
| 1669 | HFIUW36 | Cancer |
| 1670 | HFIVA74 | Musculoskeletal |
| 1671 | HFIVB57 | Digestive, Musculoskeletal, Reproductive |
| 1672 | HFIXC91 | Cancer |
| 1673 | HFIYI70 | Cancer |
| 1674 | HFKCK85 | Cancer |
| 1675 | HFKEB72 | Excretory |
| 1676 | HFKEE48 | Cancer |
| 1677 | HFKEM67 | Excretory, Neural/Sensory, Reproductive |
| 1678 | HFKEN81 | Excretory |
| 1679 | HFKET93 | Excretory, Immune/Hematopoetic, Neural/Sensory |
| 1680 | HFKFF78 | Excretory |
| 1681 | HFKFI40 | Cancer |
| 1682 | HFKFJ07 | Cancer |
| 1683 | HFKFL13 | Cancer |
| 1684 | HFKFL92 | Cancer |
| 1685 | HFKFN45 | Cancer |
| 1686 | HFKFY69 | Excretory |
| 1687 | HFKGE44 | Cancer |
| 1688 | HFKHW50 | Cancer |
| 1689 | HFKKS66 | Cancer |
| 1690 | HFKLE15 | Cancer |
| 1691 | HFKLX38 | Excretory, Respiratory |
| 1692 | HFKME15 | Excretory |
| 1693 | HFLSH80 | Cancer |
| 1694 | HFOXB55 | Cancer |
| 1695 | HFOXE30 | Musculoskeletal |
| 1696 | HFOXO72 | Musculoskeletal, Neural/Sensory, Reproductive |
| 1697 | HFOXV65 | Immune/Hematopoetic, Musculoskeletal, Reproductive |
| 1698 | HFOYC02 | Cancer |
| 1699 | HFOYV27 | Cancer |
| 1700 | HFPAA06 | Cancer |
| 1701 | HFPAE26 | Neural/Sensory |
| 1702 | HFPBA88 | Cancer |
| 1703 | HFPBD47 | Cancer |
| 1704 | HFPBM30 | Neural/Sensory |
| 1705 | HFPBW41 | Neural/Sensory |
| 1706 | HFPBY77 | Cancer |
| 1707 | HFPCN45 | Cancer |
| 1708 | HFPCT29 | Neural/Sensory |
| 1709 | HFPCY04 | Neural/Sensory |
| 1710 | HFPCY39 | Cancer |
| 1711 | HFPDB26 | Immune/Hematopoetic, Neural/Sensory, Reproductive |
| 1712 | HFPDE69 | Neural/Sensory |
| 1713 | HFPDE86 | Neural/Sensory |
| 1714 | HFPES77 | Cancer |
| 1715 | HFPFK57 | Neural/Sensory, Reproductive |
| 1716 | HFPHA80 | Neural/Sensory |
| 1717 | HFPHB92 | Excretory, Neural/Sensory |
| 1718 | HFPHS77 | Cancer |
| 1719 | HFRAC19 | Neural/Sensory |
| 1720 | HFRAW86 | Neural/Sensory |
| 1721 | HFRBF28 | Neural/Sensory |
| 1722 | HFRBR70 | Cancer |
| 1723 | HFRBU14 | Neural/Sensory |
| 1724 | HFSAY85 | Cancer |
| 1725 | HFSBG13 | Immune/Hematopoetic |
| 1726 | HFTAB66 | Digestive, Neural/Sensory |
| 1727 | HFTBE43 | Cancer |
| 1728 | HFTBN23 | Cancer |
| 1729 | HFTBQ52 | Cancer |
| 1730 | HFTBS49 | Immune/Hematopoetic, Neural/Sensory, Reproductive |
| 1731 | HFTBY59 | Cancer |
| 1732 | HFTBY96 | Immune/Hematopoetic, Neural/Sensory, Reproductive |
| 1733 | HFTCR15 | Neural/Sensory |
| 1734 | HFTCT67 | Connective/Epithelial, Digestive, Neural/Sensory |
| 1735 | HFTDJ36 | Cancer |
| 1736 | HFVGM16 | Cancer |
| 1737 | HFVGR41 | Cancer |
| 1738 | HFVGZ42 | Cancer |
| 1739 | HFVGZ79 | Cancer |
| 1740 | HFVHE58 | Cancer |
| 1741 | HFVHR84 | Connective/Epithelial, Digestive |
| 1742 | HFVHY45 | Digestive, Neural/Sensory |
| 1743 | HFVIC62 | Digestive, Immune/Hematopoetic, Reproductive |
| 1744 | HFVJP07 | Digestive, Immune/Hematopoetic |
| 1745 | HFVJY02 | Digestive, Mixed Fetal, Neural/Sensory |
| 1746 | HFVKC95 | Cancer |
| 1747 | HFXAX45 | Neural/Sensory |
| 1748 | HFXBJ12 | Neural/Sensory |
| 1749 | HFXBO84 | Neural/Sensory |
| 1750 | HFXBS43 | Neural/Sensory |
| 1751 | HFXBS68 | Neural/Sensory |
| 1752 | HFXBT12 | Immune/Hematopoetic, Neural/Sensory |
| 1753 | HFXBW09 | Neural/Sensory |
| 1754 | HFXBW82 | Neural/Sensory |
| 1755 | HFXDE67 | Neural/Sensory |
| 1756 | HFXDG13 | Cancer |
| 1757 | HFXDI56 | Immune/Hematopoetic, Musculoskeletal, Neural/Sensory |
| 1758 | HFXDK20 | Immune/Hematopoetic, Neural/Sensory |
| 1759 | HFXDN34 | Neural/Sensory |
| 1760 | HFXDO60 | Immune/Hematopoetic, Neural/Sensory |
| 1761 | HFXDT43 | Neural/Sensory |
| 1762 | HFXDX75 | Neural/Sensory |
| 1763 | HFXDZ79 | Neural/Sensory |
| 1764 | HFXFG45 | Neural/Sensory |
| 1765 | HFXFH04 | Immune/Hematopoetic, Neural/Sensory |
| 1766 | HFXFZ81 | Neural/Sensory |
| 1767 | HFXGT58 | Neural/Sensory |
| 1768 | HFXGW52 | Neural/Sensory |
| 1769 | HFXHC41 | Neural/Sensory, Reproductive |
| 1770 | HFXHC85 | Cancer |
| 1771 | HFXHK32 | Neural/Sensory |
| 1772 | HFXHM17 | Digestive, Neural/Sensory, Reproductive |
| 1773 | HFXHN31 | Neural/Sensory |
| 1774 | HFXHN68 | Cancer |
| 1775 | HFXHO83 | Cancer |
| 1776 | HFXJC53 | Neural/Sensory, Reproductive, Respiratory |
| 1777 | HFXJM91 | Cancer |
| 1778 | HFXJW48 | Cancer |
| 1779 | HFXJY38 | Neural/Sensory |
| 1780 | HFXJZ18 | Neural/Sensory |
| 1781 | HFXKD36 | Digestive, Musculoskeletal, Neural/Sensory |
| 1782 | HFXKK25 | Cancer |
| 1783 | HFXKL58 | Cancer |
| 1784 | HFXKR54 | Endocrine, Immune/Hematopoetic, Neural/Sensory |

TABLE 1C-continued

| Gene No. | cDNA Clone ID: | Preferred Indications: |
|---|---|---|
| 1785 | HFXLL52 | Neural/Sensory |
| 1786 | HGBAC11 | Cancer |
| 1787 | HGBAJ60 | Cancer |
| 1788 | HGBAJ93 | Cancer |
| 1789 | HGBAR55 | Cancer |
| 1790 | HGBBQ69 | Cancer |
| 1791 | HGBCO51 | Cancer |
| 1792 | HGBDH53 | Cancer |
| 1793 | HGBDL30 | Digestive |
| 1794 | HGBDY06 | Cancer |
| 1795 | HGBGO11 | Digestive, Immune/Hematopoetic |
| 1796 | HGBGV89 | Digestive |
| 1797 | HGBHK46 | Digestive |
| 1798 | HGBHM10 | Cancer |
| 1799 | HGBHM89 | Cancer |
| 1800 | HGBHR26 | Digestive |
| 1801 | HGCAB62 | Cancer |
| 1802 | HGCAC66 | Cancer |
| 1803 | HGCNC48 | Reproductive |
| 1804 | HGLAJ51 | Cancer |
| 1805 | HGLAM46 | Cancer |
| 1806 | HGLAM53 | Immune/Hematopoetic, Neural/Sensory, Reproductive |
| 1807 | HGLAM56 | Cancer |
| 1808 | HGLAW96 | Immune/Hematopoetic, Neural/Sensory |
| 1809 | HGLDB64 | Cancer |
| 1810 | HGLDE38 | Cancer |
| 1811 | HGOCD38 | Cancer |
| 1812 | HHAAC17 | Digestive, Musculoskeletal, Neural/Sensory |
| 1813 | HHATA33 | Cancer |
| 1814 | HHAUQ28 | Immune/Hematopoetic |
| 1815 | HHBAG14 | Cancer |
| 1816 | HHBGF77 | Cancer |
| 1817 | HHEAD14 | Cancer |
| 1818 | HHEAH25 | Cancer |
| 1819 | HHEAH86 | Cancer |
| 1820 | HHEBW54 | Cancer |
| 1821 | HHEDD41 | Cancer |
| 1822 | HHEDN80 | Cancer |
| 1823 | HHEFO24 | Cardiovascular, Immune/Hematopoetic, Neural/Sensory |
| 1824 | HHEMO80 | Immune/Hematopoetic |
| 1825 | HHEMQ28 | Digestive, Immune/Hematopoetic, Neural/Sensory |
| 1826 | HHEND31 | Cancer |
| 1827 | HHENL07 | Immune/Hematopoetic |
| 1828 | HHENW77 | Cancer |
| 1829 | HHENZ16 | Cancer |
| 1830 | HHEPF59 | Cancer |
| 1831 | HHEPG23 | Cancer |
| 1832 | HHEPG41 | Cancer |
| 1833 | HHEPJ23 | Cancer |
| 1834 | HHEPL34 | Immune/Hematopoetic |
| 1835 | HHEPU32 | Cancer |
| 1836 | HHEQR55 | Immune/Hematopoetic |
| 1837 | HHESQ62 | Immune/Hematopoetic |
| 1838 | HHEXM06 | Immune/Hematopoetic |
| 1839 | HHFBY69 | Cancer |
| 1840 | HHFCE59 | Cancer |
| 1841 | HHFCF08 | Cancer |
| 1842 | HHFCJ31 | Cardiovascular, Connective/Epithelial, Reproductive |
| 1843 | HHFCP32 | Cancer |
| 1844 | HHFCW75 | Cardiovascular |
| 1845 | HHFCY66 | Cardiovascular, Immune/Hematopoetic, Mixed Fetal |
| 1846 | HHFCZ67 | Cardiovascular |
| 1847 | HHFDG44 | Cardiovascular, Endocrine, Immune/Hematopoetic |
| 1848 | HHFDG51 | Connective/Epithelial, Musculoskeletal |
| 1849 | HHFDH56 | Cardiovascular, Immune/Hematopoetic, Neural/Sensory |
| 1850 | HHFDL91 | Cancer |
| 1851 | HHFDM48 | Cardiovascular, Neural/Sensory, Reproductive |
| 1852 | HHFDN48 | Cancer |
| 1853 | HHFDN67 | Cardiovascular |
| 1854 | HHFFU55 | Cancer |
| 1855 | HHFGA11 | Cancer |
| 1856 | HHFHD01 | Cardiovascular, Musculoskeletal, Neural/Sensory |
| 1857 | HHFHD37 | Cardiovascular, Immune/Hematopoetic, Respiratory |
| 1858 | HHFHD92 | Cancer |
| 1859 | HHFHH34 | Cardiovascular |
| 1860 | HHFHI76 | Cardiovascular, Immune/Hematopoetic, Reproductive |
| 1861 | HHFHP90 | Cardiovascular |
| 1862 | HHFHV86 | Cardiovascular, Digestive |
| 1863 | HHFKM76 | Cancer |
| 1864 | HHFLH45 | Cardiovascular, Reproductive |
| 1865 | HHFML08 | Cardiovascular, Immune/Hematopoetic, Mixed Fetal |
| 1866 | HHFOS77 | Cancer |
| 1867 | HHFUC40 | Cardiovascular |
| 1868 | HHGAS83 | Digestive, Immune/Hematopoetic |
| 1869 | HHGAU81 | Cancer |
| 1870 | HHGBC54 | Cancer |
| 1871 | HHGBF89 | Mixed Fetal |
| 1872 | HHGBK24 | Cancer |
| 1873 | HHGBO65 | Cardiovascular |
| 1874 | HHGBR15 | Cancer |
| 1875 | HHGCL33 | Cancer |
| 1876 | HHGCN69 | Digestive, Immune/Hematopoetic, Reproductive |
| 1877 | HHGCO88 | Cancer |
| 1878 | HHGCP52 | Cancer |
| 1879 | HHGCU49 | Cancer |
| 1880 | HHGCW91 | Digestive, Immune/Hematopoetic |
| 1881 | HHGDB72 | Cancer |
| 1882 | HHGDC01 | Cancer |
| 1883 | HHGDE24 | Cancer |
| 1884 | HHGDI71 | Excretory |
| 1885 | HHGDM70 | Immune/Hematopoetic |
| 1886 | HHGDO13 | Cancer |
| 1887 | HHGDU58 | Musculoskeletal |
| 1888 | HHLAB07 | Digestive, Immune/Hematopoetic |
| 1889 | HHLAB61 | Digestive |
| 1890 | HHLBA14 | Cancer |
| 1891 | HHLBA89 | Digestive |
| 1892 | HHNAA05 | Digestive |
| 1893 | HHNAB56 | Digestive |
| 1894 | HHPBI45 | Cardiovascular, Neural/Sensory |
| 1895 | HHPDV90 | Cancer |
| 1896 | HHPDW05 | Neural/Sensory |
| 1897 | HHPFD63 | Endocrine, Immune/Hematopoetic, Neural/Sensory |
| 1898 | HHPFU18 | Cancer |
| 1899 | HHPSD37 | Cancer |
| 1900 | HHPSF70 | Cancer |
| 1901 | HHPTD20 | Cancer |
| 1902 | HHSAK25 | Immune/Hematopoetic, Neural/Sensory |
| 1903 | HHSBJ93 | Digestive, Immune/Hematopoetic, Neural/Sensory |
| 1904 | HHSDI45 | Cancer |
| 1905 | HHSDI68 | Neural/Sensory |
| 1906 | HHSDR11 | Neural/Sensory |
| 1907 | HHSDT26 | Neural/Sensory |
| 1908 | HHSEB66 | Cancer |
| 1909 | HHSEG23 | Neural/Sensory |
| 1910 | HHSFB67 | Neural/Sensory |
| 1911 | HHSGH19 | Neural/Sensory |
| 1912 | HHTLH52 | Digestive, Neural/Sensory, Reproductive |
| 1913 | HHTMM10 | Immune/Hematopoetic, Neural/Sensory |
| 1914 | HHTMM30 | Cancer |
| 1915 | HIABC55 | Cancer |
| 1916 | HIASB53 | Cancer |
| 1917 | HIBCB67 | Cancer |
| 1918 | HIBCE35 | Cancer |
| 1919 | HIBCO28 | Cancer |
| 1920 | HIBCW32 | Cancer |
| 1921 | HIBEB47 | Mixed Fetal, Neural/Sensory |
| 1922 | HIBED17 | Cancer |
| 1923 | HIBEU15 | Excretory, Immune/Hematopoetic, Neural/Sensory |
| 1924 | HIDAF73 | Cancer |
| 1925 | HILCG67 | Cancer |
| 1926 | HLPAJ43 | Cancer |
| 1927 | HIPBA31 | Cancer |
| 1928 | HISAD54 | Cancer |
| 1929 | HISAG02 | Cancer |
| 1930 | HJSAQ04 | Digestive, Neural/Sensory, Reproductive |
| 1931 | HISBF60 | Cancer |
| 1932 | HISBL03 | Cancer |
| 1933 | HISBT59 | Cancer |
| 1934 | HISCJ55 | Digestive |

TABLE 1C-continued

| Gene No. | cDNA Clone ID: | Preferred Indications: |
|---|---|---|
| 1935 | HISCL83 | Digestive |
| 1936 | HISCN02 | Digestive |
| 1937 | HISCV60 | Digestive |
| 1938 | HISEN93 | Cancer |
| 1939 | HISES66 | Digestive, Reproductive |
| 1940 | HISET33 | Digestive |
| 1941 | HJAAJ58 | Immune/Hematopoetic |
| 1942 | HJAAM10 | Cancer |
| 1943 | HJAAT30 | Cancer |
| 1944 | HJAAU36 | Cancer |
| 1945 | HJABC16 | Immune/Hematopoetic |
| 1946 | HJABL02 | Cancer |
| 1947 | HJABZ65 | Cardiovascular, Immune/Hematopoetic, Musculoskeletal |
| 1948 | HJACB89 | Cancer |
| 1949 | HJACE05 | Cancer |
| 1950 | HJACG02 | Digestive, Immune/Hematopoetic |
| 1951 | HJBAF16 | Cancer |
| 1952 | HJBAR01 | Cancer |
| 1953 | HJBCD89 | Cancer |
| 1954 | HJBCG12 | Cancer |
| 1955 | HJBCY84 | Cancer |
| 1956 | HJMAG88 | Cancer |
| 1957 | HJMAN03 | Cancer |
| 1958 | HJMAV91 | Reproductive |
| 1959 | HJMBF77 | Cancer |
| 1960 | HJPAV06 | Cancer |
| 1961 | HJPAY76 | Cancer |
| 1962 | HJPBB39 | Cancer |
| 1963 | HJPCD40 | Cancer |
| 1964 | HJPCE80 | Cancer |
| 1965 | HJPCR70 | Cancer |
| 1966 | HJPCY06 | Cancer |
| 1967 | HJPDD28 | Cancer |
| 1968 | HJPDJ64 | Cancer |
| 1969 | HJTAA17 | Cancer |
| 1970 | HJTAD07 | Cancer |
| 1971 | HKAAV61 | Connective/Epithelial, Digestive, Reproductive |
| 1972 | HKABN45 | Cancer |
| 1973 | HKABT24 | Connective/Epithelial, Digestive, Immune/Hematopoetic |
| 1974 | HKABW11 | Cancer |
| 1975 | HKABY55 | Cancer |
| 1976 | HKACC80 | Cancer |
| 1977 | HKACU58 | Cancer |
| 1978 | HKADJ17 | Connective/Epithelial, Immune/Hematopoetic, Reproductive |
| 1979 | HKADX21 | Cancer |
| 1980 | HKAEA19 | Cancer |
| 1981 | HKAEL28 | Connective/Epithelial, Immune/Hematopoetic, Reproductive |
| 1982 | HKAFB88 | Cancer |
| 1983 | HKAFH74 | Cancer |
| 1984 | HKAHL26 | Cancer |
| 1985 | HKAHN23 | Connective/Epithelial, Digestive, Mixed Fetal |
| 1986 | HKAIA52 | Cancer |
| 1987 | HKAJF71 | Connective/Epithelial, Immune/Hematopoetic, Musculoskeletal |
| 1988 | HKAJK47 | Cancer |
| 1989 | HKAJW28 | Cancer |
| 1990 | HKAKK09 | Connective/Epithelial, Digestive, Mixed Fetal |
| 1991 | HKAOS84 | Connective/Epithelial |
| 1992 | HKAOV90 | Cancer |
| 1993 | HKBAB11 | Immune/Hematopoetic |
| 1994 | HKBAL25 | Cancer |
| 1995 | HKCSO46 | Cancer |
| 1996 | HKDBK22 | Excretory |
| 1997 | HKFBB67 | Connective/Epithelial, Immune/Hematopoetic, Reproductive |
| 1998 | HKFBH93 | Digestive, Reproductive |
| 1999 | HKGAA73 | Cancer |
| 2000 | HKGAH42 | Neural/Sensory |
| 2001 | HKGAJ54 | Cancer |
| 2002 | HKGAK22 | Endocrine, Excretory, Neural/Sensory |
| 2003 | HKGAM07 | Digestive, Endocrine |
| 2004 | HKGAM29 | Digestive, Immune/Hematopoetic |
| 2005 | HKGAR66 | Cancer |
| 2006 | HKGAS32 | Connective/Epithelial, Neural/Sensory |
| 2007 | HKGAU45 | Immune/Hematopoetic |
| 2008 | HKGAV60 | Cancer |
| 2009 | HKGAX42 | Digestive, Immune/Hematopoetic, Reproductive |
| 2010 | HKGAZ06 | Immune/Hematopoetic |
| 2011 | HKGBF67 | Cancer |
| 2012 | HKGBH24 | Mixed Fetal |
| 2013 | HKGBJ74 | Reproductive |
| 2014 | HKGBS01 | Cancer |
| 2015 | HKGBS49 | Reproductive |
| 2016 | HKGCK61 | Cancer |
| 2017 | HKGCN17 | Cancer |
| 2018 | HKGCR51 | Immune/Hematopoetic, Mixed Fetal, Neural/Sensory |
| 2019 | HKGDE09 | Cancer |
| 2020 | HKGDJ35 | Cancer |
| 2021 | HKGDJ66 | Cancer |
| 2022 | HKIAC30 | Cancer |
| 2023 | HKISA27 | Cancer |
| 2024 | HKIXB95 | Cancer |
| 2025 | HKIXE06 | Cancer |
| 2026 | HKIXI03 | Excretory |
| 2027 | HKIXL73 | Cancer |
| 2028 | HKIYA46 | Cancer |
| 2029 | HKIYE96 | Excretory |
| 2030 | HKIYI48 | Cancer |
| 2031 | HKIYO61 | Excretory |
| 2032 | HKIYQ65 | Cancer |
| 2033 | HKLAB16 | Cancer |
| 2034 | HKLSA57 | Digestive |
| 2035 | HKAAB92 | Cancer |
| 2036 | HKMLH01 | Cancer |
| 2037 | HKMLM65 | Excretory |
| 2038 | HKMLN51 | Cancer |
| 2039 | HKMLX18 | Cancer |
| 2040 | HKMMM61 | Excretory |
| 2041 | HKMMU22 | Excretory |
| 2042 | HKMMV77 | Excretory, Reproductive |
| 2043 | HKMNC43 | Excretory |
| 2044 | HKNAA95 | Digestive, Excretory, Immune/Hematopoetic |
| 2045 | HKPAD05 | Cancer |
| 2046 | HKPAD17 | Excretory |
| 2047 | HKPMB11 | Digestive, Excretory, Musculoskeletal |
| 2048 | HKTAC77 | Cancer |
| 2049 | HKTAE71 | Cancer |
| 2050 | HKZAH22 | Reproductive |
| 2051 | HKZAO35 | Reproductive |
| 2052 | HKZAS29 | Cancer |
| 2053 | HKZBS01 | Reproductive |
| 2054 | HKZCK47 | Immune/Hematopoetic, Reproductive |
| 2055 | HL1BD22 | Cancer |
| 2056 | HL2AC08 | Cancer |
| 2057 | HL2AG87 | Immune/Hematopoetic, Neural/Sensory, Reproductive |
| 2058 | HL3AA35 | Reproductive |
| 2059 | HL3AB91 | Immune/Hematopoetic |
| 2060 | HLCAA05 | Cancer |
| 2061 | HLDAB75 | Cancer |
| 2062 | HLDBB60 | Digestive, Neural/Sensory, Reproductive |
| 2063 | HLDBI84 | Cancer |
| 2064 | HLDBO49 | Cancer |
| 2065 | HLDBQ19 | Cancer |
| 2066 | HLDBS43 | Cancer |
| 2067 | HLDBW08 | Digestive |
| 2068 | HLDBY02 | Cancer |
| 2069 | HLDCD04 | Cancer |
| 2070 | HLDCE79 | Digestive |
| 2071 | HLDNK64 | Cancer |
| 2072 | HLDOJ66 | Digestive |
| 2073 | HLDOJ68 | Cancer |
| 2074 | HLDOK36 | Cancer |
| 2075 | HLDQA07 | Digestive |
| 2076 | HLDQZ72 | Cancer |
| 2077 | HLEDB16 | Cancer |
| 2078 | HLFBI27 | Respiratory |
| 2079 | HLHAY19 | Cancer |
| 2080 | HLHBV54 | Respiratory |

TABLE 1C-continued

| Gene No. | cDNA Clone ID: | Preferred Indications: |
|---|---|---|
| 2081 | HLHCC76 | Cancer |
| 2082 | HLHCF36 | Respiratory |
| 2083 | HLHCH40 | Cancer |
| 2084 | HLHCI58 | Cancer |
| 2085 | HLHCM89 | Cancer |
| 2086 | HLHDL42 | Cancer |
| 2087 | HLHDP16 | Cancer |
| 2088 | HLHDP65 | Cancer |
| 2089 | HLHDP83 | Cancer |
| 2090 | HLHDS67 | Cancer |
| 2091 | HLHDS79 | Cancer |
| 2092 | HLHDT18 | Cancer |
| 2093 | HLHDZ58 | Respiratory |
| 2094 | HLHEB47 | Cancer |
| 2095 | HLHEF26 | Cancer |
| 2096 | HLHEF54 | Cancer |
| 2097 | HLHEO50 | Cancer |
| 2098 | HLHEY02 | Endocrine, Respiratory |
| 2099 | HLHFE92 | Cancer |
| 2100 | HLHFM06 | Cancer |
| 2101 | HLHFP18 | Cancer |
| 2102 | HLHFR19 | Neural/Sensory, Reproductive, Respiratory |
| 2103 | HLHSA86 | Respiratory |
| 2104 | HLHSH36 | Cancer |
| 2105 | HLHSK94 | Cancer |
| 2106 | HLHSV96 | Respiratory |
| 2107 | HLHTC70 | Digestive, Immune/Hematopoetic, Respiratory |
| 2108 | HLHTP35 | Cancer |
| 2109 | HLJBF86 | Cancer |
| 2110 | HLJEA01 | Respiratory |
| 2111 | HLLAX19 | Cancer |
| 2112 | HLMAZ95 | Cancer |
| 2113 | HLMBA30 | Immune/Hematopoetic |
| 2114 | HLMBP18 | Immune/Hematopoetic |
| 2115 | HLMCA92 | Digestive, Immune/Hematopoetic, Neural/Sensory |
| 2116 | HLMDO03 | Cancer |
| 2117 | HLMFC07 | Cancer |
| 2118 | HLMFC54 | Immune/Hematopoetic |
| 2119 | HLMFD11 | Immune/Hematopoetic |
| 2120 | HLMFD85 | Immune/Hematopoetic |
| 2121 | HLMFG37 | Cancer |
| 2122 | HLMIG41 | Immune/Hematopoetic |
| 2123 | HLMIS23 | Immune/Hematopoetic, Musculoskeletal |
| 2124 | HLMIV11 | Immune/Hematopoetic |
| 2125 | HLMIW92 | Cancer |
| 2126 | HLMIY86 | Cancer |
| 2127 | HLMMJ13 | Immune/Hematopoetic, Musculoskeletal, Reproductive |
| 2128 | HLMMJ78 | Immune/Hematopoetic |
| 2129 | HLMMO64 | Immune/Hematopoetic, Reproductive |
| 2130 | HLMMU76 | Cancer |
| 2131 | HLNAB07 | Immune/Hematopoetic |
| 2132 | HLQAM28 | Digestive, Reproductive |
| 2133 | HLQBQ38 | Cancer |
| 2134 | HLQBQ85 | Cancer |
| 2135 | HLQBQ86 | Cancer |
| 2136 | HLQBR11 | Cancer |
| 2137 | HLQBR41 | Digestive, Mixed Fetal, Neural/Sensory |
| 2138 | HLQBV04 | Cancer |
| 2139 | HLQCJ74 | Digestive, Immune/Hematopoetic |
| 2140 | HLQCK07 | Digestive |
| 2141 | HLQCW84 | Digestive |
| 2142 | HLQDY81 | Cardiovascular, Digestive, Musculoskeletal |
| 2143 | HLQGP82 | Cancer |
| 2144 | HLSAD65 | Cancer |
| 2145 | HLSAF81 | Cancer |
| 2146 | HLTAF58 | Digestive, Immune/Hematopoetic |
| 2147 | HLTAI94 | Immune/Hematopoetic, Reproductive |
| 2148 | HLTBF35 | Cancer |
| 2149 | HLTBL58 | Immune/Hematopoetic, Musculoskeletal, Neural/Sensory |
| 2150 | HLTBS22 | Cancer |
| 2151 | HLTBU43 | Immune/Hematopoetic |
| 2152 | HLTBX31 | Cancer |
| 2153 | HLTCJ63 | Immune/Hematopoetic, Neural/Sensory, Reproductive |
| 2154 | HLTCR13 | Cancer |
| 2155 | HLTCS34 | Cancer |
| 2156 | HLTCY93 | Cancer |
| 2157 | HLTDB65 | Cancer |
| 2158 | HLTDE74 | Cancer |
| 2159 | HLTDW13 | Cancer |
| 2160 | HLTDY51 | Cancer |
| 2161 | HLTEF12 | Cancer |
| 2162 | HLTEI25 | Immune/Hematopoetic |
| 2163 | HLTEK17 | Cancer |
| 2164 | HLTER03 | Immune/Hematopoetic |
| 2165 | HLTER45 | Cancer |
| 2166 | HLTEY63 | Cancer |
| 2167 | HLTGX30 | Immune/Hematopoetic |
| 2168 | HLTHO84 | Cancer |
| 2169 | HLTIP27 | Immune/Hematopoetic |
| 2170 | HLUDB47 | Cancer |
| 2171 | HLWAD92 | Cancer |
| 2172 | HLWAT72 | Cancer |
| 2173 | HLWAX42 | Reproductive |
| 2174 | HLWAX74 | Cancer |
| 2175 | HLWAZ66 | Cancer |
| 2176 | HLWAZ70 | Cancer |
| 2177 | HLWBF94 | Endocrine, Neural/Sensory, Reproductive |
| 2178 | HLWBG83 | Cancer |
| 2179 | HLWBM40 | Neural/Sensory, Reproductive |
| 2180 | HLWBT09 | Reproductive |
| 2181 | HLWBZ21 | Immune/Hematopoetic, Reproductive |
| 2182 | HLWBZ56 | Immune/Hematopoetic, Reproductive |
| 2183 | HLWBZ73 | Cancer |
| 2184 | HLWCP78 | Cancer |
| 2185 | HLWCU38 | Cancer |
| 2186 | HLWEA51 | Cancer |
| 2187 | HLYAA57 | Immune/Hematopoetic |
| 2188 | HLYAB80 | Cancer |
| 2189 | HLYAG19 | Digestive, Immune/Hematopoetic |
| 2190 | HLYAN43 | Cancer |
| 2191 | HLYBA22 | Immune/Hematopoetic |
| 2192 | HLYBA69 | Cancer |
| 2193 | HLYBF22 | Immune/Hematopoetic, Mixed Fetal |
| 2194 | HLYBI18 | Immune/Hematopoetic |
| 2195 | HLYBI58 | Cancer |
| 2196 | HLYBV47 | Cancer |
| 2197 | HLYBY48 | Immune/Hematopoetic |
| 2198 | HLYCH68 | Cancer |
| 2199 | HLYCK27 | Immune/Hematopoetic |
| 2200 | HLYCQ18 | Immune/Hematopoetic |
| 2201 | HLYCQ48 | Immune/Hematopoetic |
| 2202 | HLYCR65 | Cancer |
| 2203 | HLYCT47 | Digestive, Immune/Hematopoetic |
| 2204 | HLYDU25 | Immune/Hematopoetic |
| 2205 | HLYDU43 | Cancer |
| 2206 | HLYLA71 | Cancer |
| 2207 | HMACO04 | Cancer |
| 2208 | HMACS20 | Cancer |
| 2209 | HMADJ14 | Connective/Epithelial, Immune/Hematopoetic, Musculoskeletal |
| 2210 | HMADW66 | Cancer |
| 2211 | HMAGA15 | Cancer |
| 2212 | HMAGK93 | Cancer |
| 2213 | HMAHY59 | Cancer |
| 2214 | HMAJL22 | Cancer |
| 2215 | HMAJR50 | Cancer |
| 2216 | HMALI42 | Immune/Hematopoetic, Reproductive |
| 2217 | HMCAL59 | Cancer |
| 2218 | HMCAR20 | Cancer |
| 2219 | HMCAV55 | Immune/Hematopoetic |
| 2220 | HMCDK27 | Cancer |
| 2221 | HMCDX48 | Cancer |
| 2222 | HMCEH49 | Cancer |
| 2223 | HMCHR48 | Connective/Epithelial, Immune/Hematopoetic, Reproductive |
| 2224 | HMCIJ07 | Immune/Hematopoetic |
| 2225 | HMDAA66 | Neural/Sensory |
| 2226 | HMDAI51 | Neural/Sensory |
| 2227 | HMDAK33 | Neural/Sensory |
| 2228 | HMDAL04 | Neural/Sensory |

TABLE 1C-continued

| Gene No. | cDNA Clone ID: | Preferred Indications: |
|---|---|---|
| 2229 | HMDAL49 | Neural/Sensory |
| 2230 | HMDAP35 | Neural/Sensory |
| 2231 | HMEAI74 | Cancer |
| 2232 | HMEAL02 | Cardiovascular, Neural/Sensory |
| 2233 | HMEEJ79 | Cardiovascular, Neural/Sensory, Reproductive |
| 2234 | HMEFS61 | Cardiovascular |
| 2235 | HMEFT85 | Cancer |
| 2236 | HMEIK34 | Cancer |
| 2237 | HMEJE05 | Cancer |
| 2238 | HMEJE13 | Cancer |
| 2239 | HMEJE31 | Cardiovascular |
| 2240 | HMEJJ27 | Cardiovascular |
| 2241 | HMEJL08 | Cancer |
| 2242 | HMEJL61 | Cancer |
| 2243 | HMEJQ66 | Cardiovascular |
| 2244 | HMEJQ68 | Cancer |
| 2245 | HMEJY78 | Cancer |
| 2246 | HMEKT48 | Cancer |
| 2247 | HMEKU83 | Cardiovascular, Immune/Hematopoetic, Reproductive |
| 2248 | HMELA16 | Cardiovascular, Immune/Hematopoetic |
| 2249 | HMELR03 | Cardiovascular, Immune/Hematopoetic, Mixed Fetal |
| 2250 | HMHBE18 | Cancer |
| 2251 | HMHBN86 | Cancer |
| 2252 | HMIAJ30 | Cancer |
| 2253 | HMIAL40 | Musculoskeletal, Neural/Sensory |
| 2254 | HMIAM45 | Neural/Sensory |
| 2255 | HMIAS24 | Immune/Hematopoetic, Neural/Sensory |
| 2256 | HMIAV27 | Cancer |
| 2257 | HMIAV73 | Cancer |
| 2258 | HMIAW81 | Immune/Hematopoetic, Neural/Sensory, Reproductive |
| 2259 | HMICK94 | Cancer |
| 2260 | HMICP03 | Cancer |
| 2261 | HMJAG94 | Neural/Sensory |
| 2262 | HMJAK50 | Neural/Sensory |
| 2263 | HMJAK63 | Neural/Sensory |
| 2264 | HMJAX71 | Neural/Sensory |
| 2265 | HMKAH10 | Neural/Sensory, Reproductive |
| 2266 | HMKAH44 | Cancer |
| 2267 | HMKAI25 | Cancer |
| 2268 | HMKCH52 | Neural/Sensory |
| 2269 | HMKCP66 | Neural/Sensory |
| 2270 | HMKCV28 | Neural/Sensory |
| 2271 | HMKCW19 | Cancer |
| 2272 | HMKCY17 | Cardiovascular, Digestive, Neural/Sensory |
| 2273 | HMKDD07 | Immune/Hematopoetic, Neural/Sensory |
| 2274 | HMKDS08 | Excretory, Neural/Sensory |
| 2275 | HMMAD08 | Immune/Hematopoetic |
| 2276 | HMMAS76 | Endocrine, Immune/Hematopoetic |
| 2277 | HMMBD35 | Cancer |
| 2278 | HMMBF71 | Immune/Hematopoetic |
| 2279 | HMMCJ60 | Immune/Hematopoetic, Musculoskeletal |
| 2280 | HMQAG66 | Immune/Hematopoetic |
| 2281 | HMQAJ64 | Connective/Epithelial, Immune/Hematopoetic, Reproductive |
| 2282 | HMQBO88 | Cancer |
| 2283 | HMQBU44 | Cancer |
| 2284 | HMQBU45 | Cancer |
| 2285 | HMQCY03 | Immune/Hematopoetic |
| 2286 | HMQDW19 | Immune/Hematopoetic |
| 2287 | HMRAD54 | Cancer |
| 2288 | HMSAC18 | Cancer |
| 2289 | HMSAW68 | Cancer |
| 2290 | HMSBX84 | Immune/Hematopoetic |
| 2291 | HMSCD68 | Cancer |
| 2292 | HMSCM88 | Immune/Hematopoetic |
| 2293 | HMSCT72 | Immune/Hematopoetic |
| 2294 | HMSCX69 | Digestive, Immune/Hematopoetic, Neural/Sensory |
| 2295 | HMSEL55 | Immune/Hematopoetic |
| 2296 | HMSFK67 | Cancer |
| 2297 | HMSFP50 | Digestive, Immune/Hematopoetic, Musculoskeletal |
| 2298 | HMSGK61 | Cancer |
| 2299 | HMSGP80 | Cancer |
| 2300 | HMSHM43 | Immune/Hematopoetic |
| 2301 | HMSHQ24 | Cancer |
| 2302 | HMSHY73 | Cancer |
| 2303 | HMSII78 | Cancer |
| 2304 | HMSIV91 | Cancer |
| 2305 | HMSJJ74 | Cancer |
| 2306 | HMSJO79 | Cancer |
| 2307 | HMSJR08 | Immune/Hematopoetic |
| 2308 | HMSJW18 | Cancer |
| 2309 | HMSJX24 | Immune/Hematopoetic |
| 2310 | HMSKC10 | Immune/Hematopoetic |
| 2311 | HMSKH19 | Cancer |
| 2312 | HMSKI86 | Cancer |
| 2313 | HMSKQ35 | Cancer |
| 2314 | HMSKS35 | Immune/Hematopoetic |
| 2315 | HMSLC09 | Immune/Hematopoetic |
| 2316 | HMSMD07 | Cancer |
| 2317 | HMSOC30 | Cancer |
| 2318 | HMSOW51 | Cancer |
| 2319 | HMTAC69 | Cancer |
| 2320 | HMTAE85 | Cancer |
| 2321 | HMTAK05 | Cancer |
| 2322 | HMTAL77 | Cancer |
| 2323 | HMTAT59 | Cancer |
| 2324 | HMTAX46 | Cancer |
| 2325 | HMTBE31 | Cancer |
| 2326 | HMUAI20 | Cancer |
| 2327 | HMUAO21 | Cancer |
| 2328 | HMUAW28 | Musculoskeletal |
| 2329 | HMUBU59 | Cancer |
| 2330 | HMVAM60 | Cancer |
| 2331 | HMVAV54 | Immune/Hematopoetic, Musculoskeletal |
| 2332 | HMVAX72 | Cancer |
| 2333 | HMVBP38 | Cancer |
| 2334 | HMVBR22 | Cancer |
| 2335 | HMVBS69 | Cardiovascular, Immune/Hematopoetic |
| 2336 | HMVCQ82 | Immune/Hematopoetic |
| 2337 | HMVDF54 | Cancer |
| 2338 | HMVDG26 | Cancer |
| 2339 | HMVDL30 | Cancer |
| 2340 | HMVDP35 | Immune/Hematopoetic, Reproductive |
| 2341 | HMWAJ53 | Immune/Hematopoetic |
| 2342 | HMWBC11 | Immune/Hematopoetic |
| 2343 | HMWCF89 | Cancer |
| 2344 | HMWDC93 | Immune/Hematopoetic |
| 2345 | HMWDZ81 | Immune/Hematopoetic |
| 2346 | HMWEC56 | Cancer |
| 2347 | HMWEC64 | Immune/Hematopoetic |
| 2348 | HMWEJ52 | Cancer |
| 2349 | HMWEY26 | Cancer |
| 2350 | HMWFG79 | Immune/Hematopoetic |
| 2351 | HMWFT53 | Immune/Hematopoetic |
| 2352 | HMWGQ73 | Cancer |
| 2353 | HMWGU74 | Immune/Hematopoetic |
| 2354 | HMWGY01 | Immune/Hematopoetic |
| 2355 | HMWHC36 | Cancer |
| 2356 | HMWHH16 | Immune/Hematopoetic |
| 2357 | HMWHS73 | Immune/Hematopoetic |
| 2358 | HMWHX28 | Immune/Hematopoetic |
| 2359 | HMWIC78 | Cancer |
| 2360 | HMWID22 | Immune/Hematopoetic, Neural/Sensory |
| 2361 | HMWIG83 | Cancer |
| 2362 | HMWIO93 | Cancer |
| 2363 | HMZAD77 | Cancer |
| 2364 | HMZME33 | Digestive |
| 2365 | HMZMF54 | Digestive |
| 2366 | HNAAF65 | Cancer |
| 2367 | HNALC70 | Cancer |
| 2368 | HNALE36 | Digestive, Reproductive |
| 2369 | HNBAF49 | Cancer |
| 2370 | HNBUC50 | Cancer |
| 2371 | HNDAH54 | Cancer |
| 2372 | HNEBN76 | Immune/Hematopoetic, Reproductive, Respiratory |
| 2373 | HNEBY54 | Cancer |
| 2374 | HNECF34 | Immune/Hematopoetic |
| 2375 | HNECL25 | Immune/Hematopoetic |
| 2376 | HNECU95 | Connective/Epithelial, Immune/Hematopoetic |
| 2377 | HNEDD37 | Cancer |
| 2378 | HNEDF25 | Cancer |
| 2379 | HNEDJ35 | Immune/Hematopoetic, Reproductive |

TABLE 1C-continued

| Gene No. | cDNA Clone ID: | Preferred Indications: |
|---|---|---|
| 2380 | HNFAE54 | Cancer |
| 2381 | HNFAH08 | Cancer |
| 2382 | HNFCK41 | Cancer |
| 2383 | HNFCV70 | Cancer |
| 2384 | HNFDS53 | Digestive, Immune/Hematopoetic, Neural/Sensory |
| 2385 | HNFED65 | Excretory, Immune/Hematopoetic |
| 2386 | HNFEG11 | Immune/Hematopoetic |
| 2387 | HNFEG93 | Cancer |
| 2388 | HNFET17 | Cancer |
| 2389 | HNFEY18 | Cancer |
| 2390 | HNFFC27 | Immune/Hematopoetic |
| 2391 | HNFFC39 | Immune/Hematopoetic, Reproductive |
| 2392 | HNFFD47 | Immune/Hematopoetic |
| 2393 | HNFFI46 | Cancer |
| 2394 | HNFFY60 | Cancer |
| 2395 | HNFFZ56 | Cancer |
| 2396 | HNFGF45 | Cancer |
| 2397 | HNFGZ45 | Cardiovascular, Digestive, Immune/Hematopoetic |
| 2398 | HNFHD08 | Cancer |
| 2399 | HNFHS38 | Immune/Hematopoetic, Mixed Fetal |
| 2400 | HNFHY30 | Immune/Hematopoetic |
| 2401 | HNFHY51 | Immune/Hematopoetic, Reproductive |
| 2402 | HNFID82 | Immune/Hematopoetic |
| 2403 | HNFIG36 | Immune/Hematopoetic |
| 2404 | HNFIR81 | Cancer |
| 2405 | HNFIS82 | Digestive, Immune/Hematopoetic, Reproductive |
| 2406 | HNFIU96 | Immune/Hematopoetic |
| 2407 | HNFIZ34 | Cancer |
| 2408 | HNFJD91 | Cardiovascular, Connective/Epithelial, Immune/Hematopoetic |
| 2409 | HNFJE06 | Immune/Hematopoetic, Musculoskeletal |
| 2410 | HNGAC63 | Immune/Hematopoetic |
| 2411 | HNGAK13 | Digestive, Immune/Hematopoetic |
| 2412 | HNGAL31 | Immune/Hematopoetic |
| 2413 | HNGAM20 | Immune/Hematopoetic |
| 2414 | HNGAN75 | Immune/Hematopoetic |
| 2415 | HNGAO10 | Immune/Hematopoetic |
| 2416 | HNGAU09 | Immune/Hematopoetic |
| 2417 | HNGAV42 | Immune/Hematopoetic |
| 2418 | HNGAV54 | Immune/Hematopoetic |
| 2419 | HNGAX58 | Immune/Hematopoetic |
| 2420 | HNGAZ20 | Immune/Hematopoetic |
| 2421 | HNGAZ68 | Cardiovascular, Digestive, Immune/Hematopoetic |
| 2422 | HNGBB17 | Excretory, Immune/Hematopoetic, Reproductive |
| 2423 | HNGBE45 | Immune/Hematopoetic, Reproductive |
| 2424 | HNGBJ27 | Immune/Hematopoetic |
| 2425 | HNGBO16 | Immune/Hematopoetic |
| 2426 | HNGBQ56 | Cancer |
| 2427 | HNGBQ90 | Cancer |
| 2428 | HNGBU28 | Immune/Hematopoetic |
| 2429 | HNGBV36 | Cancer |
| 2430 | HNGBV72 | Cancer |
| 2431 | HNGBX63 | Immune/Hematopoetic |
| 2432 | HNGCF72 | Immune/Hematopoetic |
| 2433 | HNGCL23 | Immune/Hematopoetic |
| 2434 | HNGDD48 | Immune/Hematopoetic |
| 2435 | HNGDE27 | Immune/Hematopoetic |
| 2436 | HNGDP26 | Immune/Hematopoetic |
| 2437 | HNGDQ28 | Immune/Hematopoetic |
| 2438 | HNGDQ52 | Immune/Hematopoetic |
| 2439 | HNGDS13 | Immune/Hematopoetic |
| 2440 | HNGDS53 | Immune/Hematopoetic |
| 2441 | HNGDU92 | Immune/Hematopoetic |
| 2442 | HNGED06 | Immune/Hematopoetic |
| 2443 | HNGEI34 | Immune/Hematopoetic |
| 2444 | HNGEJ53 | Immune/Hematopoetic |
| 2445 | HNGEM24 | Immune/Hematopoetic |
| 2446 | HNGEM62 | Immune/Hematopoetic |
| 2447 | HNGEN81 | Immune/Hematopoetic |
| 2448 | HNGEQ48 | Immune/Hematopoetic |
| 2449 | HNGEU17 | Immune/Hematopoetic |
| 2450 | HNGEU90 | Immune/Hematopoetic |
| 2451 | HNGEV29 | Digestive, Immune/Hematopoetic |
| 2452 | HNGEW13 | Immune/Hematopoetic |
| 2453 | HNGEW65 | Endocrine, Immune/Hematopoetic |
| 2454 | HNGEY29 | Cancer |
| 2455 | HNGEY51 | Immune/Hematopoetic |
| 2456 | HNGEZ47 | Immune/Hematopoetic |
| 2457 | HNGFB76 | Digestive, Immune/Hematopoetic, Neural/Sensory |
| 2458 | HNGFE55 | Immune/Hematopoetic |
| 2459 | HNGFI02 | Immune/Hematopoetic |
| 2460 | HNGFJ67 | Immune/Hematopoetic |
| 2461 | HNGFQ33 | Immune/Hematopoetic |
| 2462 | HNGFR75 | Immune/Hematopoetic |
| 2463 | HNGFT78 | Immune/Hematopoetic |
| 2464 | HNGFU38 | Immune/Hematopoetic |
| 2465 | HNGFW58 | Cancer |
| 2466 | HNGGB09 | Immune/Hematopoetic |
| 2467 | HNGGF85 | Immune/Hematopoetic |
| 2468 | HNGGK54 | Cancer |
| 2469 | HNGGR26 | Immune/Hematopoetic |
| 2470 | HNGHJ73 | Immune/Hematopoetic |
| 2471 | HNGHM75 | Immune/Hematopoetic |
| 2472 | HNGHQ09 | Immune/Hematopoetic |
| 2473 | HNGHT03 | Immune/Hematopoetic |
| 2474 | HNGIC13 | Immune/Hematopoetic |
| 2475 | HNGIC24 | Immune/Hematopoetic |
| 2476 | HNGIC80 | Immune/Hematopoetic |
| 2477 | HNGIK21 | Immune/Hematopoetic |
| 2478 | HNGIK36 | Immune/Hematopoetic |
| 2479 | HNGIN16 | Digestive, Immune/Hematopoetic, Reproductive |
| 2480 | HNGIN60 | Immune/Hematopoetic, Neural/Sensory |
| 2481 | HNGIN84 | Digestive, Endocrine, Immune/Hematopoetic |
| 2482 | HNGIO50 | Immune/Hematopoetic |
| 2483 | HNGIQ57 | Immune/Hematopoetic |
| 2484 | HNGIR58 | Immune/Hematopoetic |
| 2485 | HNGIT16 | Immune/Hematopoetic |
| 2486 | HNGIX55 | Immune/Hematopoetic |
| 2487 | HNGIZ06 | Immune/Hematopoetic |
| 2488 | HNGJA38 | Immune/Hematopoetic |
| 2489 | HNGJB81 | Immune/Hematopoetic |
| 2490 | HNGJF62 | Immune/Hematopoetic |
| 2491 | HNGJF70 | Immune/Hematopoetic |
| 2492 | HNGJF92 | Immune/Hematopoetic |
| 2493 | HNGJG84 | Immune/Hematopoetic |
| 2494 | HNGJH08 | Immune/Hematopoetic |
| 2495 | HNGJH63 | Immune/Hematopoetic |
| 2496 | HNGJH85 | Immune/Hematopoetic |
| 2497 | HNGJJ65 | Immune/Hematopoetic |
| 2498 | HNGJL11 | Immune/Hematopoetic, Musculoskeletal |
| 2499 | HNGJM08 | Cancer |
| 2500 | HNGJM27 | Immune/Hematopoetic |
| 2501 | HNGJP90 | Immune/Hematopoetic |
| 2502 | HNGJR78 | Immune/Hematopoetic |
| 2503 | HNGJU42 | Immune/Hematopoetic |
| 2504 | HNGJU84 | Immune/Hematopoetic |
| 2505 | HNGKN89 | Immune/Hematopoetic |
| 2506 | HNGLH60 | Immune/Hematopoetic, Musculoskeletal |
| 2507 | HNGLM62 | Cancer |
| 2508 | HNGMJ91 | Immune/Hematopoetic |
| 2509 | HNGNB69 | Immune/Hematopoetic |
| 2510 | HNGNI25 | Immune/Hematopoetic |
| 2511 | HNGNN78 | Cancer |
| 2512 | HNGNS74 | Cancer |
| 2513 | HNGNW50 | Immune/Hematopoetic, Mixed Fetal, Reproductive |
| 2514 | HNGOD80 | Cancer |
| 2515 | HNGOQ44 | Immune/Hematopoetic |
| 2516 | HNGOU82 | Immune/Hematopoetic, Reproductive |
| 2517 | HNGPM78 | Immune/Hematopoetic, Neural/Sensory |
| 2518 | HNHAB62 | Immune/Hematopoetic |
| 2519 | HNHAD65 | Immune/Hematopoetic |
| 2520 | HNHAF39 | Immune/Hematopoetic |
| 2521 | HNHAL34 | Cancer |
| 2522 | HNHAZ16 | Immune/Hematopoetic |
| 2523 | HNHBE49 | Immune/Hematopoetic |
| 2524 | HNHBI47 | Immune/Hematopoetic |
| 2525 | HNHBI75 | Immune/Hematopoetic |
| 2526 | HNHBL26 | Immune/Hematopoetic |
| 2527 | HNHBM26 | Immune/Hematopoetic, Reproductive |
| 2528 | HNHBM80 | Immune/Hematopoetic, Reproductive |
| 2529 | HNHCM59 | Cancer |
| 2530 | HNHCR46 | Cardiovascular, Immune/Hematopoetic |

TABLE 1C-continued

| Gene No. | cDNA Clone ID: | Preferred Indications: |
|---|---|---|
| 2531 | HNHDA78 | Immune/Hematopoetic |
| 2532 | HNHDL85 | Immune/Hematopoetic |
| 2533 | HNHDL95 | Immune/Hematopoetic |
| 2534 | HNHDR03 | Immune/Hematopoetic |
| 2535 | HNHDR64 | Immune/Hematopoetic |
| 2536 | HNHDU48 | Immune/Hematopoetic |
| 2537 | HNHDX07 | Immune/Hematopoetic |
| 2538 | HNHDY21 | Immune/Hematopoetic |
| 2539 | HNHEA64 | Immune/Hematopoetic |
| 2540 | HNHEC59 | Immune/Hematopoetic |
| 2541 | HNHEC63 | Immune/Hematopoetic |
| 2542 | HNHED86 | Immune/Hematopoetic |
| 2543 | HNHEE88 | Immune/Hematopoetic |
| 2544 | HNHEI47 | Immune/Hematopoetic |
| 2545 | HNHEI54 | Immune/Hematopoetic, Reproductive |
| 2546 | HNHEI85 | Digestive, Immune/Hematopoetic, Musculoskeletal |
| 2547 | HNHEJ88 | Immune/Hematopoetic, Neural/Sensory |
| 2548 | HNHEK61 | Immune/Hematopoetic |
| 2549 | HNHEK85 | Immune/Hematopoetic, Mixed Fetal |
| 2550 | HNHEL19 | Immune/Hematopoetic, Reproductive |
| 2551 | HNHEN68 | Immune/Hematopoetic |
| 2552 | HNHEO73 | Immune/Hematopoetic |
| 2553 | HNHEP59 | Immune/Hematopoetic |
| 2554 | HNHER77 | Immune/Hematopoetic |
| 2555 | HNHES40 | Immune/Hematopoetic |
| 2556 | HNHET53 | Immune/Hematopoetic |
| 2557 | HNHEU34 | Immune/Hematopoetic |
| 2558 | HNHEV43 | Cancer |
| 2559 | HNHEX30 | Immune/Hematopoetic |
| 2560 | HNHEZ51 | Immune/Hematopoetic |
| 2561 | HNHFB16 | Immune/Hematopoetic |
| 2562 | HNHFB60 | Immune/Hematopoetic |
| 2563 | HNHFG05 | Immune/Hematopoetic |
| 2564 | HNHFH41 | Immune/Hematopoetic |
| 2565 | HNHFI33 | Immune/Hematopoetic |
| 2566 | HNHFI81 | Immune/Hematopoetic |
| 2567 | HNHFJ25 | Immune/Hematopoetic |
| 2568 | HNHFL04 | Immune/Hematopoetic |
| 2569 | HNHFL46 | Immune/Hematopoetic |
| 2570 | HNHFL57 | Immune/Hematopoetic |
| 2571 | HNHFP80 | Immune/Hematopoetic |
| 2572 | HNHFQ63 | Immune/Hematopoetic |
| 2573 | HNUFS63 | Digestive, Immune/Hematopoetic |
| 2574 | HNHFU59 | Immune/Hematopoetic |
| 2575 | HNHFW22 | Immune/Hematopoetic |
| 2576 | HNHGB09 | Immune/Hematopoetic |
| 2577 | HNHGC56 | Immune/Hematopoetic |
| 2578 | HNHGC82 | Immune/Hematopoetic |
| 2579 | HNHGD15 | Immune/Hematopoetic |
| 2580 | HNHGE28 | Cancer |
| 2581 | HNHGE75 | Immune/Hematopoetic |
| 2582 | HNHGN74 | Immune/Hematopoetic |
| 2583 | HNHGN91 | Digestive, Endocrine, Immune/Hematopoetic |
| 2584 | HNHGO09 | Immune/Hematopoetic |
| 2585 | HNHHA15 | Immune/Hematopoetic |
| 2586 | HNHHD42 | Immune/Hematopoetic |
| 2587 | HNHIC21 | Immune/Hematopoetic |
| 2588 | HNHKJ57 | Immune/Hematopoetic |
| 2589 | HNHKL90 | Immune/Hematopoetic |
| 2590 | HNHKS18 | Immune/Hematopoetic |
| 2591 | HNHKY10 | Immune/Hematopoetic |
| 2592 | HNHLA36 | Immune/Hematopoetic, Reproductive |
| 2593 | HNHLB93 | Immune/Hematopoetic |
| 2594 | HNHLD23 | Immune/Hematopoetic |
| 2595 | HNHLY33 | Immune/Hematopoetic |
| 2596 | HNHMV54 | Immune/Hematopoetic |
| 2597 | HNHNE04 | Immune/Hematopoetic |
| 2598 | HNHNT13 | Immune/Hematopoetic, Neural/Sensory |
| 2599 | HNHNW84 | Immune/Hematopoetic |
| 2600 | HNHOD23 | Cancer |
| 2601 | HNHOJ75 | Immune/Hematopoetic |
| 2602 | HNHOL24 | Immune/Hematopoetic |
| 2603 | HNHON23 | Digestive, Endocrine, Immune/Hematopoetic |
| 2604 | HNHPD10 | Immune/Hematopoetic |
| 2605 | HNHPG05 | Immune/Hematopoetic |
| 2606 | HNKAA41 | Cancer |
| 2607 | HNKCO80 | Cancer |
| 2608 | HNKEL47 | Cardiovascular, Connective/Epithelial, Digestive |
| 2609 | HNNBM45 | Immune/Hematopoetic, Reproductive |
| 2610 | HNSAA27 | Digestive |
| 2611 | HNSAD53 | Digestive |
| 2612 | HNTAC64 | Cancer |
| 2613 | HNTAC73 | Cancer |
| 2614 | HNTAI35 | Cancer |
| 2615 | HNTAS52 | Cancer |
| 2616 | HNTBI57 | Cancer |
| 2617 | HNTBN41 | Immune/Hematopoetic |
| 2618 | HNTBP17 | Cancer |
| 2619 | HNTCH90 | Cancer |
| 2620 | HNTDE84 | Cancer |
| 2621 | HNTDL21 | Cancer |
| 2622 | HNTDX22 | Cancer |
| 2623 | HNTEF28 | Cancer |
| 2624 | HNTEF53 | Cancer |
| 2625 | HNTEO78 | Digestive, Immune/Hematopoetic |
| 2626 | HNTEO95 | Immune/Hematopoetic |
| 2627 | HNTMX29 | Cancer |
| 2628 | HNTMZ90 | Digestive, Reproductive |
| 2629 | HNTNB49 | Cancer |
| 2630 | HNTNK95 | Cancer |
| 2631 | HNTOE45 | Cancer |
| 2632 | HNTPB82 | Connective/Epithelial, Immune/Hematopoetic, Reproductive |
| 2633 | HNTRS57 | Cancer |
| 2634 | HNTRW30 | Digestive, Immune/Hematopoetic, Mixed Fetal |
| 2635 | HNTSJ84 | Cancer |
| 2636 | HNTSL47 | Cardiovascular, Digestive |
| 2637 | HNTSM04 | Cancer |
| 2638 | HNTSN12 | Cancer |
| 2639 | HNTSS75 | Cancer |
| 2640 | HNTSW57 | Cancer |
| 2641 | HOAAE80 | Cancer |
| 2642 | HOAAF80 | Cancer |
| 2643 | HOABG65 | Musculoskeletal |
| 2644 | HOABL56 | Cancer |
| 2645 | HOABP21 | Cancer |
| 2646 | HOABR60 | Cancer |
| 2647 | HOACG37 | Digestive, Musculoskeletal |
| 2648 | HOBAF11 | Cancer |
| 2649 | HOCNE30 | Digestive, Musculoskeletal, Neural/Sensory |
| 2650 | HOCOO19 | Cancer |
| 2651 | HOCPM23 | Reproductive |
| 2652 | HODAA12 | Immune/Hematopoetic, Neural/Sensory, Reproductive |
| 2653 | HODAE92 | Cancer |
| 2654 | HODAH46 | Cancer |
| 2655 | HODAH74 | Connective/Epithelial, Reproductive, Respiratory |
| 2656 | HODAV86 | Cancer |
| 2657 | HODAZ26 | Cancer |
| 2658 | HODAZ55 | Reproductive |
| 2659 | HODBF19 | Cancer |
| 2660 | HODCJ90 | Cancer |
| 2661 | HODCL36 | Cancer |
| 2662 | HODCL50 | Reproductive |
| 2663 | HODCU34 | Cancer |
| 2664 | HODCV74 | Cancer |
| 2665 | HODCZ09 | Reproductive |
| 2666 | HODCZ16 | Cancer |
| 2667 | HODDB05 | Digestive, Neural/Sensory, Reproductive |
| 2668 | HODDD43 | Cancer |
| 2669 | HODDF08 | Reproductive |
| 2670 | HODDN60 | Cancer |
| 2671 | HODEA51 | Digestive, Immune/Hematopoetic, Reproductive |
| 2672 | HODEB50 | Reproductive |
| 2673 | HODEE95 | Digestive, Reproductive |
| 2674 | HODEI83 | Reproductive |
| 2675 | HODFG71 | Reproductive |
| 2676 | HODFW41 | Reproductive |
| 2677 | HODGL52 | Cancer |
| 2678 | HODHE60 | Reproductive |
| 2679 | HODHK19 | Reproductive |
| 2680 | HOEBI94 | Cancer |
| 2681 | HOECN31 | Cancer |

TABLE 1C-continued

| Gene No. | cDNA Clone ID: | Preferred Indications: |
|---|---|---|
| 2682 | HOECO90 | Cancer |
| 2683 | HOECU83 | Cancer |
| 2684 | HOEEK12 | Cancer |
| 2685 | HOEEU24 | Cancer |
| 2686 | HOEFO68 | Cancer |
| 2687 | HOEFV61 | Cancer |
| 2688 | HOEJH89 | Cancer |
| 2689 | HOFAF39 | Reproductive |
| 2690 | HOFMA42 | Reproductive |
| 2691 | HOFMM69 | Reproductive |
| 2692 | HOFMU07 | Reproductive |
| 2693 | HOFNM53 | Reproductive |
| 2694 | HOFNT24 | Reproductive |
| 2695 | HOFNY71 | Reproductive |
| 2696 | HOFNZ45 | Cancer |
| 2697 | HOFOA59 | Reproductive |
| 2698 | HOFOB27 | Cancer |
| 2699 | HOGAG15 | Cancer |
| 2700 | HOGAR52 | Cancer |
| 2701 | HOGCE48 | Cancer |
| 2702 | HOGDP46 | Cancer |
| 2703 | HOHBL42 | Cancer |
| 2704 | HOHBP82 | Musculoskeletal |
| 2705 | HOHBV89 | Musculoskeletal, Reproductive |
| 2706 | HOHBY69 | Cancer |
| 2707 | HOHCA35 | Cancer |
| 2708 | HOHCG16 | Digestive, Musculoskeletal |
| 2709 | HOHCJ90 | Cancer |
| 2710 | HOHDC86 | Musculoskeletal |
| 2711 | HOHDF66 | Cancer |
| 2712 | HONAH29 | Cancer |
| 2713 | HORBI81 | Cancer |
| 2714 | HOSBI96 | Cancer |
| 2715 | HOSBZ55 | Cancer |
| 2716 | HOSCI83 | Cancer |
| 2717 | HOSCY73 | Cancer |
| 2718 | HOSCZ41 | Cancer |
| 2719 | HOSDG32 | Cancer |
| 2720 | HOSDI92 | Cancer |
| 2721 | HOSDK95 | Musculoskeletal |
| 2722 | HOSDW58 | Cancer |
| 2723 | HOSEI45 | Cancer |
| 2724 | HOSEK86 | Cancer |
| 2725 | HOSFC36 | Cancer |
| 2726 | HOSFF78 | Cancer |
| 2727 | HOSFG70 | Cancer |
| 2728 | HOSFM22 | Cancer |
| 2729 | HOSFQ28 | Cancer |
| 2730 | HOSFQ65 | Cancer |
| 2731 | HOSFT61 | Cancer |
| 2732 | HOSNU69 | Cancer |
| 2733 | HOUAR65 | Connective/Epithelial |
| 2734 | HOUBE18 | Cancer |
| 2735 | HOUCT90 | Connective/Epithelial |
| 2736 | HOUCW42 | Connective/Epithelial |
| 2737 | HOUCZ78 | Connective/Epithelial, Immune/Hematopoetic, Reproductive |
| 2738 | HOUDJ81 | Cancer |
| 2739 | HOUDL69 | Cancer |
| 2740 | HOUDU29 | Cancer |
| 2741 | HOUFU35 | Connective/Epithelial |
| 2742 | HOUHD63 | Cancer |
| 2743 | HOUHH51 | Cancer |
| 2744 | HOUHT39 | Cancer |
| 2745 | HOVAF78 | Cancer |
| 2746 | HOVAI58 | Reproductive |
| 2747 | HOVAP06 | Reproductive |
| 2748 | HOVAZ13 | Cancer |
| 2749 | HOVBX78 | Cancer |
| 2750 | HOVCB25 | Reproductive |
| 2751 | HOVJP29 | Reproductive |
| 2752 | HPAMY60 | Excretory |
| 2753 | HPASD51 | Digestive, Excretory, Reproductive |
| 2754 | HPBCC51 | Cancer |
| 2755 | HPBCJ74 | Cancer |
| 2756 | HPBDD36 | Cancer |
| 2757 | HPBDH41 | Immune/Hematopoetic, Musculoskeletal |
| 2758 | HPBEN24 | Cancer |
| 2759 | HPBEQ12 | Cancer |
| 2760 | HPCAL49 | Immune/Hematopoetic, Neural/Sensory, Reproductive |
| 2761 | HPCAM01 | Cancer |
| 2762 | HPCAO10 | Cancer |
| 2763 | HPEAA33 | Reproductive |
| 2764 | HPEAB57 | Reproductive |
| 2765 | HPEAD48 | Reproductive |
| 2766 | HPEAE34 | Reproductive |
| 2767 | HPEBD85 | Digestive, Reproductive |
| 2768 | HPEBE79 | Reproductive |
| 2769 | HPEBT80 | Immune/Hematopoetic, Reproductive |
| 2770 | HPEBT96 | Cancer |
| 2771 | HPFCE63 | Digestive, Musculoskeletal, Reproductive |
| 2772 | HPFCM07 | Cancer |
| 2773 | HPFCR13 | Cancer |
| 2774 | HPFCR15 | Digestive, Mixed Fetal, Reproductive |
| 2775 | HPFCX38 | Cancer |
| 2776 | HPFCX44 | Cancer |
| 2777 | HPFCY51 | Reproductive |
| 2778 | HPFDU90 | Cancer |
| 2779 | HPHAC88 | Cancer |
| 2780 | HPIAT78 | Cancer |
| 2781 | HPIBO48 | Cancer |
| 2782 | HPIBT55 | Cancer |
| 2783 | HPIBX03 | Cancer |
| 2784 | HPICC86 | Reproductive |
| 2785 | HPJAP43 | Cancer |
| 2786 | HPJBK03 | Cancer |
| 2787 | HPJBK11 | Cancer |
| 2788 | HPJBZ76 | Cancer |
| 2789 | HPJCC05 | Reproductive |
| 2790 | HPJCG42 | Immune/Hematopoetic, Reproductive |
| 2791 | HPJCK10 | Cancer |
| 2792 | HPJCL28 | Neural/Sensory, Reproductive |
| 2793 | HPJCP79 | Cancer |
| 2794 | HPJCT08 | Connective/Epithelial, Reproductive |
| 2795 | HPJDA23 | Mixed Fetal, Neural/Sensory, Reproductive |
| 2796 | HPJDM47 | Reproductive |
| 2797 | HPJEC20 | Connective/Epithelial, Reproductive |
| 2798 | HPJEE14 | Reproductive |
| 2799 | HPJEG57 | Reproductive |
| 2800 | HPJEV11 | Immune/Hematopoetic, Neural/Sensory, Reproductive |
| 2801 | HPJEZ38 | Cancer |
| 2802 | HPLAT69 | Cancer |
| 2803 | HPMAG94 | Cancer |
| 2804 | HPMBQ32 | Neural/Sensory, Reproductive |
| 2805 | HPMBQ91 | Reproductive |
| 2806 | HPMBR15 | Cancer |
| 2807 | HPMBU33 | Immune/Hematopoetic, Musculoskeletal, Reproductive |
| 2808 | HPMBY46 | Cancer |
| 2809 | HPMBZ15 | Cancer |
| 2810 | HPMCC16 | Cancer |
| 2811 | HPMCJ92 | Musculoskeletal, Reproductive |
| 2812 | HPMCU14 | Cancer |
| 2813 | HPMCV08 | Cancer |
| 2814 | HPMCV18 | Musculoskeletal, Reproductive |
| 2815 | HPMEI44 | Cancer |
| 2816 | HPMEI86 | Cancer |
| 2817 | HPMFI71 | Cancer |
| 2818 | HPMFS15 | Reproductive |
| 2819 | HPMFY57 | Immune/Hematopoetic, Reproductive |
| 2820 | HPMFY74 | Reproductive |
| 2821 | HPMGD01 | Cancer |
| 2822 | HPMGP24 | Reproductive |
| 2823 | HPMGQ55 | Digestive, Immune/Hematopoetic, Reproductive |
| 2824 | HPMGQ80 | Cancer |
| 2825 | HPMGR66 | Cancer |
| 2826 | HPMGT51 | Immune/Hematopoetic, Musculoskeletal, Reproductive |
| 2827 | HPMKI40 | Immune/Hematopoetic, Reproductive |
| 2828 | HPMSM14 | Cancer |
| 2829 | HPQSH59 | Cancer |
| 2830 | HPRCA90 | Cancer |

TABLE 1C-continued

| Gene No. | cDNA Clone ID: | Preferred Indications: |
|---|---|---|
| 2831 | HPRCE33 | Cancer |
| 2832 | HPRCS53 | Reproductive |
| 2833 | HPRCU95 | Musculoskeletal, Reproductive |
| 2834 | HPRTG55 | Cancer |
| 2835 | HPTBB03 | Cancer |
| 2836 | HPTRC15 | Cancer |
| 2837 | HPTRF90 | Cancer |
| 2838 | HPTRH45 | Digestive, Endocrine, Reproductive |
| 2839 | HPTRH57 | Cancer |
| 2840 | HPTRO86 | Cancer |
| 2841 | HPTTI70 | Cancer |
| 2842 | HPTVX32 | Cancer |
| 2843 | HPTWA66 | Cancer |
| 2844 | HPTWC08 | Cancer |
| 2845 | HPWAG46 | Reproductive |
| 2846 | HPWAL61 | Musculoskeletal, Reproductive |
| 2847 | HPWAN23 | Cancer |
| 2848 | HPWAS91 | Reproductive |
| 2849 | HPWCM76 | Reproductive |
| 2850 | HRAAJ19 | Cancer |
| 2851 | HRAAL86 | Excretory |
| 2852 | HRAAM50 | Excretory, Immune/Hematopoetic, Mixed Fetal |
| 2853 | HRAAN56 | Excretory |
| 2854 | HRABS65 | Cancer |
| 2855 | HRABV43 | Cancer |
| 2856 | HRABX31 | Excretory, Immune/Hematopoetic, Musculoskeletal |
| 2857 | HRACG45 | Cancer |
| 2858 | HRACI26 | Digestive, Excretory |
| 2859 | HRACM44 | Excretory, Immune/Hematopoetic |
| 2860 | HRADO01 | Excretory |
| 2861 | HRAEE45 | Connective/Epithelial, Excretory, Immune/Hematopoetic |
| 2862 | HRAEH37 | Cancer |
| 2863 | HRDAD66 | Cancer |
| 2864 | HRDBT68 | Cancer |
| 2865 | HRDDR94 | Cancer |
| 2866 | HRDDS01 | Musculoskeletal |
| 2867 | HRDEC77 | Cancer |
| 2868 | HRDED19 | Musculoskeletal |
| 2869 | HRDEL61 | Musculoskeletal |
| 2870 | HRDEN56 | Musculoskeletal |
| 2871 | HRDEP41 | Cancer |
| 2872 | HRDES01 | Musculoskeletal |
| 2873 | HRDEU27 | Musculoskeletal |
| 2874 | HRDFB85 | Cancer |
| 2875 | HRGBR18 | Cancer |
| 2876 | HRGBR28 | Cancer |
| 2877 | HRGCZ46 | Cancer |
| 2878 | HRGDC48 | Immune/Hematopoetic, Musculoskeletal |
| 2879 | HRKAB52 | Cancer |
| 2880 | HRKPA09 | Cancer |
| 2881 | HRLMB56 | Cancer |
| 2882 | HRLMD77 | Cancer |
| 2883 | HRLMF92 | Cancer |
| 2884 | HROAE16 | Cancer |
| 2885 | HROAE78 | Digestive |
| 2886 | HROAH06 | Digestive, Immune/Hematopoetic |
| 2887 | HROAN56 | Digestive |
| 2888 | HROAS46 | Digestive |
| 2889 | HROBM46 | Connective/Epithelial, Digestive |
| 2890 | HRODZ89 | Digestive, Immune/Hematopoetic |
| 2891 | HRSMC69 | Cancer |
| 2892 | HRSMF51 | Cancer |
| 2893 | HRSMG27 | Cancer |
| 2894 | HRSMQ86 | Cancer |
| 2895 | HSAAO30 | Cancer |
| 2896 | HSAAO65 | Cancer |
| 2897 | HSAAO65 | Cancer |
| 2898 | HSAAO94 | Cancer |
| 2899 | HSABI42 | Immune/Hematopoetic |
| 2900 | HSATA21 | Immune/Hematopoetic |
| 2901 | HSAUA82 | Immune/Hematopoetic, Reproductive |
| 2902 | HSAUC38 | Immune/Hematopoetic |
| 2903 | HSAUF22 | Immune/Hematopoetic |
| 2904 | HSAUF49 | Immune/Hematopoetic |
| 2905 | HSAUL66 | Immune/Hematopoetic, Musculoskeletal |
| 2906 | HSAUM95 | Digestive, Immune/Hematopoetic, Reproductive |
| 2907 | HSAUR67 | Immune/Hematopoetic |
| 2908 | HSAUW44 | Immune/Hematopoetic |
| 2909 | HSAVJ61 | Immune/Hematopoetic |
| 2910 | HSAVP17 | Immune/Hematopoetic |
| 2911 | HSAVU34 | Cancer |
| 2912 | HSAWA27 | Immune/Hematopoetic |
| 2913 | HSAWG42 | Immune/Hematopoetic |
| 2914 | HSAWV96 | Immune/Hematopoetic, Neural/Sensory |
| 2915 | HSAXB32 | Immune/Hematopoetic |
| 2916 | HSAXB81 | Immune/Hematopoetic |
| 2917 | HSAXF60 | Immune/Hematopoetic |
| 2918 | HSAXI90 | Immune/Hematopoetic |
| 2919 | HSAXI95 | Immune/Hematopoetic |
| 2920 | HSAXJ29 | Immune/Hematopoetic |
| 2921 | HSAXJ60 | Immune/Hematopoetic |
| 2922 | HSAXM32 | Cancer |
| 2923 | HSAXN46 | Immune/Hematopoetic |
| 2924 | HSAXS66 | Immune/Hematopoetic |
| 2925 | HSAYC21 | Immune/Hematopoetic |
| 2926 | HSAYL90 | Cardiovascular, Immune/Hematopoetic |
| 2927 | HSAYR13 | Immune/Hematopoetic |
| 2928 | HSAYS89 | Immune/Hematopoetic |
| 2929 | HSAZG33 | Immune/Hematopoetic |
| 2930 | HSBBT12 | Cancer |
| 2931 | HSBBT37 | Cancer |
| 2932 | HSDAG05 | Cancer |
| 2933 | HSDAJ53 | Cancer |
| 2934 | HSDBC88 | Cancer |
| 2935 | HSDDC95 | Neural/Sensory |
| 2936 | HSDEG01 | Cancer |
| 2937 | HSDES04 | Cancer |
| 2938 | HSDEW29 | Neural/Sensory |
| 2939 | HSDFA44 | Neural/Sensory |
| 2940 | HSDFW45 | Neural/Sensory |
| 2941 | HSDFW61 | Cancer |
| 2942 | HSDGN55 | Cancer |
| 2943 | HSDGP60 | Immune/Hematopoetic, Musculoskeletal, Neural/Sensory |
| 2944 | HSDGR57 | Cancer |
| 2945 | HSDGW43 | Neural/Sensory |
| 2946 | HSDHC81 | Neural/Sensory |
| 2947 | HSDIE16 | Neural/Sensory |
| 2948 | HSDIL30 | Neural/Sensory |
| 2949 | HSDIT06 | Neural/Sensory, Reproductive |
| 2950 | HSDJV86 | Cancer |
| 2951 | HSDJB13 | Cancer |
| 2952 | HSDJE10 | Cancer |
| 2953 | HSDJL42 | Cancer |
| 2954 | HSDJM30 | Digestive, Neural/Sensory |
| 2955 | HSDJR23 | Digestive, Neural/Sensory |
| 2956 | HSDMA90 | Digestive, Endocrine, Neural/Sensory |
| 2957 | HSDZM95 | Cancer |
| 2958 | HSDZR95 | Neural/Sensory |
| 2959 | HSFAG37 | Cancer |
| 2960 | HSFAH43 | Cancer |
| 2961 | HSFAL43 | Cancer |
| 2962 | HSFAM39 | Reproductive |
| 2963 | HSFAM73 | Immune/Hematopoetic, Reproductive |
| 2964 | HSFAN12 | Cardiovascular |
| 2965 | HSHAV28 | Cancer |
| 2966 | HSHBQ68 | Cancer |
| 2967 | HSIAC45 | Digestive, Immune/Hematopoetic |
| 2968 | HSIAC80 | Cancer |
| 2969 | HSICO66 | Cancer |
| 2970 | HSICQ15 | Cancer |
| 2971 | HSICV24 | Digestive |
| 2972 | HSIDD28 | Cancer |
| 2973 | HSIDD62 | Cancer |
| 2974 | HSIDI15 | Digestive, Immune/Hematopoetic |
| 2975 | HSIDQ18 | Cancer |
| 2976 | HSIDQ93 | Cancer |
| 2977 | HSIDR70 | Digestive |
| 2978 | HSIDU19 | Digestive, Mixed Fetal |
| 2979 | HSIDU42 | Cancer |
| 2980 | HSIDY06 | Cancer |

TABLE 1C-continued

| Gene No. | cDNA Clone ID: | Preferred Indications: |
|---|---|---|
| 2981 | HSIEA14 | Digestive |
| 2982 | HSIEF95 | Cancer |
| 2983 | HSIFL06 | Cancer |
| 2984 | HSIFO61 | Cancer |
| 2985 | HSIFV30 | Cancer |
| 2986 | HSIGD79 | Cancer |
| 2987 | HSIGM62 | Cancer |
| 2988 | HSJAQ17 | Cancer |
| 2989 | HSJBB37 | Cancer |
| 2990 | HSKBO20 | Cancer |
| 2991 | HSKCP69 | Cancer |
| 2992 | HSKCT36 | Cancer |
| 2993 | HSKDD72 | Cardiovascular, Digestive, Musculoskeletal |
| 2994 | HSKDI81 | Cancer |
| 2995 | HSKDV92 | Cancer |
| 2996 | HSKDW91 | Musculoskeletal |
| 2997 | HSKEI54 | Cancer |
| 2998 | HSKGO49 | Cancer |
| 2999 | HSKGQ58 | Cancer |
| 3000 | HSKHL65 | Cancer |
| 3001 | HSKNB54 | Cancer |
| 3002 | HSKND71 | Cancer |
| 3003 | HSKNK73 | Cancer |
| 3004 | HSKNM85 | Digestive, Musculoskeletal |
| 3005 | HSKNT34 | Cancer |
| 3006 | HSKXE22 | Cancer |
| 3007 | HSKXJ37 | Cancer |
| 3008 | HSKYU29 | Cancer |
| 3009 | HSKZE52 | Cancer |
| 3010 | HSLBF69 | Musculoskeletal |
| 3011 | HSLCA15 | Cancer |
| 3012 | HSLCK11 | Cancer |
| 3013 | HSLCP57 | Cancer |
| 3014 | HSLCS05 | Cancer |
| 3015 | HSLCT04 | Mixed Fetal, Musculoskeletal |
| 3016 | HSLCU73 | Musculoskeletal |
| 3017 | HSLCX03 | Cancer |
| 3018 | HSLDJ89 | Cancer |
| 3019 | HSLDS06 | Musculoskeletal |
| 3020 | HSLDS32 | Musculoskeletal |
| 3021 | HSLEF58 | Cardiovascular, Digestive, Musculoskeletal |
| 3022 | HSLFD55 | Musculoskeletal |
| 3023 | HSLFM29 | Cancer |
| 3024 | HSLFU05 | Cancer |
| 3025 | HSLGM21 | Cancer |
| 3026 | HSLGM81 | Cancer |
| 3027 | HSLGU75 | Cancer |
| 3028 | HSLHI86 | Cancer |
| 3029 | HSLHS22 | Cancer |
| 3030 | HSLIA81 | Cancer |
| 3031 | HSLJW78 | Musculoskeletal |
| 3032 | HSMBE69 | Cancer |
| 3033 | HSNAA55 | Cancer |
| 3034 | HSNAQ47 | Cancer |
| 3035 | HSNAU78 | Digestive, Neural/Sensory |
| 3036 | HSNAY92 | Cancer |
| 3037 | HSNBG78 | Connective/Epithelial, Digestive, Immune/Hematopoetic |
| 3038 | HSNBM49 | Cancer |
| 3039 | HSNBN57 | Cancer |
| 3040 | HSOAC84 | Digestive |
| 3041 | HSOAH66 | Cancer |
| 3042 | HSOAJ55 | Cancer |
| 3043 | HSOAM40 | Digestive |
| 3044 | HSOBK48 | Digestive |
| 3045 | HSOBV29 | Cancer |
| 3046 | HSODB85 | Cancer |
| 3047 | HSPAA60 | Digestive |
| 3048 | HSPAH56 | Cancer |
| 3049 | HSPBY40 | Cancer |
| 3050 | HSPBY63 | Digestive |
| 3051 | HSPMG77 | Digestive |
| 3052 | HSQAB87 | Cancer |
| 3053 | HSQAC69 | Cancer |
| 3054 | HSQBE28 | Cancer |
| 3055 | HSQBL21 | Cancer |
| 3056 | HSQEA85 | Cancer |
| 3057 | HSQEH50 | Cancer |
| 3058 | HSQEO84 | Cancer |
| 3059 | HSQFP46 | Cancer |
| 3060 | HSQFT30 | Cancer |
| 3061 | HSRAL66 | Cancer |
| 3062 | HSRBA90 | Cancer |
| 3063 | HSRDE35 | Cancer |
| 3064 | HSRDH01 | Cancer |
| 3065 | HSRFB56 | Cancer |
| 3066 | HSRGW16 | Cancer |
| 3067 | HSSAO72 | Musculoskeletal, Neural/Sensory |
| 3068 | HSSEN70 | Cancer |
| 3069 | HSSEO83 | Cancer |
| 3070 | HSSFZ70 | Musculoskeletal |
| 3071 | HSSGJ45 | Cancer |
| 3072 | HSSJF55 | Musculoskeletal |
| 3073 | HSSJJ51 | Cancer |
| 3074 | HSSTN64 | Musculoskeletal |
| 3075 | HSSMS41 | Cancer |
| 3076 | HSSMW31 | Musculoskeletal, Reproductive |
| 3077 | HSTAG52 | Cancer |
| 3078 | HSUMA53 | Cancer |
| 3079 | HSUME76 | Cancer |
| 3080 | HSVAA10 | Cardiovascular |
| 3081 | HSVAC77 | Cancer |
| 3082 | HSVAF16 | Cancer |
| 3083 | HSVAG05 | Cancer |
| 3084 | HSVAK93 | Cancer |
| 3085 | HSVAM81 | Mixed Fetal |
| 3086 | HSVAQ28 | Cancer |
| 3087 | HSVAT02 | Cancer |
| 3088 | HSVAT68 | Excretory, Reproductive |
| 3089 | HSVAY16 | Cancer |
| 3090 | HSVBA12 | Cancer |
| 3091 | HSVBD22 | Cancer |
| 3092 | HSVBF78 | Cancer |
| 3093 | HSVBH58 | Cancer |
| 3094 | HSVBM90 | Cancer |
| 3095 | HSVBZ80 | Cancer |
| 3096 | HSVCB08 | Excretory, Neural/Sensory |
| 3097 | HSVCB57 | Cancer |
| 3098 | HSVCF20 | Cancer |
| 3099 | HSVCH32 | Cancer |
| 3100 | HSWAM12 | Reproductive |
| 3101 | HSWAY58 | Cancer |
| 3102 | HSWBJ74 | Reproductive |
| 3103 | HSXAG02 | Cancer |
| 3104 | HSXAH81 | Cancer |
| 3105 | HSXAM05 | Cancer |
| 3106 | HSXAR64 | Cancer |
| 3107 | HSXAS67 | Neural/Sensory, Reproductive |
| 3108 | HSXAZ05 | Neural/Sensory, Respiratory |
| 3109 | HSXBM30 | Cancer |
| 3110 | HSXBO51 | Cancer |
| 3111 | HSXBP68 | Cancer |
| 3112 | HSXBU59 | Neural/Sensory |
| 3113 | HSXBV35 | Neural/Sensory |
| 3114 | HSXBX80 | Cancer |
| 3115 | HSXCS62 | Cancer |
| 3116 | HSXCV85 | Neural/Sensory, Reproductive |
| 3117 | HSYAB05 | Cancer |
| 3118 | HSYAG26 | Cancer |
| 3119 | HSYBK21 | Cancer |
| 3120 | HSYBL17 | Cancer |
| 3121 | HSYBX48 | Cancer |
| 3122 | HSYBZ44 | Cancer |
| 3123 | HSYDT06 | Cancer |
| 3124 | HSZAA13 | Digestive, Neural/Sensory, Reproductive |
| 3125 | HT2SF14 | Cancer |
| 3126 | HT2SG64 | Digestive, Immune/Hematopoetic |
| 3127 | HT3BE24 | Cancer |
| 3128 | HT4AI54 | Cancer |
| 3129 | HT4ES80 | Cancer |
| 3130 | HT4FW61 | Connective/Epithelial, Immune/Hematopoetic, Reproductive |

TABLE 1C-continued

| Gene No. | cDNA Clone ID: | Preferred Indications: |
|---|---|---|
| 3131 | HT5EK75 | Cancer |
| 3132 | HTAAU21 | Cancer |
| 3133 | HTABP30 | Cancer |
| 3134 | HTACS42 | Cancer |
| 3135 | HTACZ01 | Immune/Hematopoetic |
| 3136 | HTADC09 | Cancer |
| 3137 | HTADH39 | Cancer |
| 3138 | HTADI12 | Cancer |
| 3139 | HTADO22 | Immune/Hematopoetic |
| 3140 | HTADV27 | Immune/Hematopoetic |
| 3141 | HTAEC92 | Cancer |
| 3142 | HTAGN51 | Cancer |
| 3143 | HTBAA70 | Connective/Epithelial, Immune/Hematopoetic, Reproductive |
| 3144 | HTBAB28 | Immune/Hematopoetic |
| 3145 | HTDAA93 | Cancer |
| 3146 | HTDAD22 | Cancer |
| 3147 | HTDAG66 | Digestive, Immune/Hematopoetic |
| 3148 | HTDAI54 | Cancer |
| 3149 | HTEAE62 | Cardiovascular, Reproductive |
| 3150 | HTEAJ18 | Reproductive |
| 3151 | HTEAN76 | Cancer |
| 3152 | HTEAR66 | Cancer |
| 3153 | HTEAT31 | Cancer |
| 3154 | HTEAV28 | Reproductive |
| 3155 | HTEAX23 | Reproductive |
| 3156 | HTEBC92 | Cancer |
| 3157 | HTEBJ71 | Cancer |
| 3158 | HTEBP77 | Immune/Hematopoetic, Reproductive |
| 3159 | HTEBY11 | Reproductive |
| 3160 | HTEBY84 | Cancer |
| 3161 | HTECE72 | Reproductive |
| 3162 | HTECE94 | Cancer |
| 3163 | HTEDF42 | Digestive, Reproductive |
| 3164 | HTEDJ85 | Mixed Fetal, Neural/Sensory, Reproductive |
| 3165 | HTEDJ94 | Cancer |
| 3166 | HTEDS39 | Cancer |
| 3167 | HTEDX90 | Reproductive |
| 3168 | HTEFU09 | Cancer |
| 3169 | HTEFU41 | Immune/Hematopoetic, Reproductive |
| 3170 | HTEGF16 | Cancer |
| 3171 | HTEGQ64 | Reproductive |
| 3172 | HTEGS19 | Cancer |
| 3173 | HTEGT82 | Digestive, Reproductive |
| 3174 | HTEHH53 | Reproductive |
| 3175 | HTEHV08 | Cancer |
| 3176 | HTEID16 | Reproductive |
| 3177 | HTEIL66 | Reproductive |
| 3178 | HTEIM65 | Immune/Hematopoetic, Reproductive |
| 3179 | HTEIR61 | Cancer |
| 3180 | HTEIT45 | Reproductive |
| 3181 | HTEJO12 | Digestive, Reproductive |
| 3182 | HTEJT39 | Neural/Sensory, Reproductive |
| 3183 | HTEKE40 | Cancer |
| 3184 | HTEKM35 | Neural/Sensory, Reproductive |
| 3185 | HTEKS16 | Connective/Epithelial, Mixed Fetal, Reproductive |
| 3186 | HTEKU58 | Cancer |
| 3187 | HTELW37 | Reproductive |
| 3188 | HTEMD27 | Cancer |
| 3189 | HTEME02 | Cancer |
| 3190 | HTEMX36 | Cancer |
| 3191 | HTENO07 | Reproductive |
| 3192 | HTEQI22 | Cancer |
| 3193 | HTFMX90 | Cancer |
| 3194 | HTFOE85 | Immune/Hematopoetic |
| 3195 | HTFOS57 | Cancer |
| 3196 | HTGAM78 | Immune/Hematopoetic, Neural/Sensory, Respiratory |
| 3197 | HTGAW51 | Immune/Hematopoetic |
| 3198 | HTGBE48 | Immune/Hematopoetic, Reproductive |
| 3199 | HTGBV53 | Immune/Hematopoetic |
| 3200 | HTGCH22 | Immune/Hematopoetic, Mixed Fetal, Reproductive |
| 3201 | HTGCM55 | Cardiovascular, Digestive, Immune/Hematopoetic |
| 3202 | HTGCQ82 | Cancer |
| 3203 | HTGEU09 | Immune/Hematopoetic |
| 3204 | HTGEW91 | Cancer |
| 3205 | HTGGO35 | Cancer |
| 3206 | HTHBH29 | Immune/Hematopoetic, Mixed Fetal |
| 3207 | HTHBK35 | Immune/Hematopoetic |
| 3208 | HTHBL86 | Immune/Hematopoetic |
| 3209 | HTHBX95 | Cancer |
| 3210 | HTHCA77 | Immune/Hematopoetic |
| 3211 | HTHCB31 | Immune/Hematopoetic, Mixed Fetal, Neural/Sensory |
| 3212 | HTHCO79 | Cancer |
| 3213 | HTHCZ41 | Cancer |
| 3214 | HTHDK34 | Digestive, Immune/Hematopoetic |
| 3215 | HTJNX29 | Cancer |
| 3216 | HTLAA40 | Reproductive |
| 3217 | HTLAB25 | Cancer |
| 3218 | HTLAB43 | Cancer |
| 3219 | HTLAF13 | Reproductive |
| 3220 | HTLAI54 | Reproductive |
| 3221 | HTLAV68 | Reproductive |
| 3222 | HTLBC79 | Reproductive |
| 3223 | HTLBG08 | Reproductive |
| 3224 | HTLCU49 | Cancer |
| 3225 | HTLCX30 | Reproductive |
| 3226 | HTLDD53 | Connective/Epithelial, Digestive, Reproductive |
| 3227 | HTLDP69 | Cancer |
| 3228 | HTLDQ11 | Reproductive |
| 3229 | HTLDQ56 | Reproductive |
| 3230 | HTLDR33 | Immune/Hematopoetic, Reproductive |
| 3231 | HTLDT76 | Cardiovascular, Neural/Sensory, Reproductive |
| 3232 | HTLDW38 | Reproductive |
| 3233 | HTLEC34 | Immune/Hematopoetic, Neural/Sensory, Reproductive |
| 3234 | HTLEF73 | Cancer |
| 3235 | HTLEK16 | Cancer |
| 3236 | HTLET08 | Cancer |
| 3237 | HTLEW81 | Cancer |
| 3238 | HTLEX50 | Cancer |
| 3239 | HTLFA90 | Cancer |
| 3240 | HTLFG05 | Cancer |
| 3241 | HTLFI93 | Immune/Hematopoetic, Reproductive, Respiratory |
| 3242 | HTLGY87 | Cancer |
| 3243 | HTLHC59 | Digestive, Reproductive |
| 3244 | HTLHI35 | Immune/Hematopoetic, Musculoskeletal, Reproductive |
| 3245 | HTLHR26 | Immune/Hematopoetic |
| 3246 | HTLIO20 | Immune/Hematopoetic, Neural/Sensory |
| 3247 | HTLIQ05 | Reproductive |
| 3248 | HTLIT63 | Reproductive |
| 3249 | HTLJC07 | Cancer |
| 3250 | HTLJF15 | Reproductive |
| 3251 | HTNAG39 | Cancer |
| 3252 | HTNBR95 | Cancer |
| 3253 | HTOAI70 | Immune/Hematopoetic |
| 3254 | HTOAM21 | Immune/Hematopoetic |
| 3255 | HTOAT76 | Excretory, Immune/Hematopoetic |
| 3256 | HTOBX52 | Cancer |
| 3257 | HTOBX69 | Cancer |
| 3258 | HTODG13 | Digestive, Immune/Hematopoetic, Reproductive |
| 3259 | HTODJ69 | Immune/Hematopoetic |
| 3260 | HTODL90 | Immune/Hematopoetic |
| 3261 | HTODL92 | Cancer |
| 3262 | HTOEU03 | Cancer |
| 3263 | HTOEY16 | Cancer |
| 3264 | HTOFC34 | Cancer |
| 3265 | HTOFD28 | Immune/Hematopoetic |
| 3266 | HTOFU06 | Immune/Hematopoetic, Musculoskeletal |
| 3267 | HTOHB55 | Cancer |
| 3268 | HTOHG09 | Cancer |
| 3269 | HTOHJ89 | Immune/Hematopoetic, Reproductive |
| 3270 | HTOHV49 | Immune/Hematopoetic |
| 3271 | HTOHW95 | Cancer |
| 3272 | HTOIQ42 | Immune/Hematopoetic |
| 3273 | HTOIW31 | Immune/Hematopoetic, Reproductive |
| 3274 | HTOIZ28 | Cancer |
| 3275 | HTOJP95 | Immune/Hematopoetic |
| 3276 | HTOJY21 | Cancer |
| 3277 | HTPAB57 | Cancer |
| 3278 | HTPBG16 | Digestive, Immune/Hematopoetic |
| 3279 | HTPBH21 | Connective/Epithelial, Digestive, Reproductive |
| 3280 | HTPBN68 | Digestive |

TABLE 1C-continued

| Gene No. | cDNA Clone ID: | Preferred Indications: |
|---|---|---|
| 3281 | HTPBQ83 | Cancer |
| 3282 | HTPBY11 | Cancer |
| 3283 | HTPCN79 | Digestive, Neural/Sensory |
| 3284 | HTPCS60 | Cancer |
| 3285 | HTPCW21 | Digestive, Neural/Sensory |
| 3286 | HTPDS14 | Cancer |
| 3287 | HTPDX06 | Cancer |
| 3288 | HTPFX16 | Digestive, Reproductive, Respiratory |
| 3289 | HTPFX69 | Digestive |
| 3290 | HTPHS66 | Cancer |
| 3291 | HTPIY88 | Digestive |
| 3292 | HTSAC80 | Cancer |
| 3293 | HTSER67 | Cancer |
| 3294 | HTSFO71 | Cancer |
| 3295 | HTSGG36 | Cancer |
| 3296 | HTSGM54 | Cancer |
| 3297 | HTSGX80 | Cancer |
| 3298 | HTSHE40 | Cancer |
| 3299 | HTTBM40 | Cancer |
| 3300 | HTTBR96 | Immune/Hematopoetic, Reproductive |
| 3301 | HTTCN24 | Cancer |
| 3302 | HTTCT79 | Cancer |
| 3303 | HTTDF41 | Cancer |
| 3304 | HTTDP47 | Cancer |
| 3305 | HTTEA24 | Digestive, Reproductive |
| 3306 | HTTEU77 | Cancer |
| 3307 | HTTEU91 | Cancer |
| 3308 | HTTEV40 | Cancer |
| 3309 | HTTEX77 | Cancer |
| 3310 | HTTFG10 | Reproductive |
| 3311 | HTTIJ31 | Reproductive |
| 3312 | HTTJK27 | Reproductive |
| 3313 | HTTKT43 | Cancer |
| 3314 | HTWAF58 | Immune/Hematopoetic |
| 3315 | HTWAH05 | Cancer |
| 3316 | HTWBY29 | Cancer |
| 3317 | HTWBY48 | Immune/Hematopoetic |
| 3318 | HTWCE16 | Immune/Hematopoetic |
| 3319 | HTWCI46 | Cancer |
| 3320 | HTWDC20 | Immune/Hematopoetic |
| 3321 | HTWDE26 | Cancer |
| 3322 | HTWEE31 | Immune/Hematopoetic |
| 3323 | HTWEL91 | Immune/Hematopoetic |
| 3324 | HTWEO25 | Cancer |
| 3325 | HTWEV82 | Immune/Hematopoetic |
| 3326 | HTWFH07 | Immune/Hematopoetic |
| 3327 | HTWFK09 | Immune/Hematopoetic |
| 3328 | HTWJB71 | Digestive, Immune/Hematopoetic, Neural/Sensory |
| 3329 | HTWKG71 | Immune/Hematopoetic |
| 3330 | HTXBK30 | Cancer |
| 3331 | HTXBN56 | Cancer |
| 3332 | HTXBU52 | Cancer |
| 3333 | HTXBX04 | Cancer |
| 3334 | HTXCS21 | Cancer |
| 3335 | HTXDB52 | Immune/Hematopoetic, Musculoskeletal |
| 3336 | HTXDE07 | Immune/Hematopoetic |
| 3337 | HTXDG40 | Immune/Hematopoetic |
| 3338 | HTXDJ88 | Immune/Hematopoetic |
| 3339 | HTXDN32 | Cancer |
| 3340 | HTXDO17 | Immune/Hematopoetic, Neural/Sensory, Respiratory |
| 3341 | HTXDP60 | Cancer |
| 3342 | HTXEB42 | Cancer |
| 3343 | HTXEL29 | Immune/Hematopoetic |
| 3344 | HTXEY51 | Endocrine, Immune/Hematopoetic |
| 3345 | HTXFB20 | Immune/Hematopoetic |
| 3346 | HTXFE73 | Cancer |
| 3347 | HTXFH55 | Cardiovascular, Immune/Hematopoetic |
| 3348 | HTXGG31 | Cancer |
| 3349 | HTXGG45 | Immune/Hematopoetic |
| 3350 | HTXGI75 | Cancer |
| 3351 | HTXHB33 | Immune/Hematopoetic |
| 3352 | HTXJI95 | Immune/Hematopoetic, Reproductive |
| 3353 | HTXJQ11 | Cancer |
| 3354 | HTXJW17 | Digestive, Immune/Hematopoetic |
| 3355 | HTXJX80 | Digestive, Immune/Hematopoetic |
| 3356 | HTXKB57 | Cancer |
| 3357 | HTXKF10 | Immune/Hematopoetic |
| 3358 | HTXKK52 | Immune/Hematopoetic |
| 3359 | HTXKQ85 | Immune/Hematopoetic, Musculoskeletal, Reproductive |
| 3360 | HTXKV29 | Cancer |
| 3361 | HTXKY63 | Immune/Hematopoetic |
| 3362 | HTXLE54 | Immune/Hematopoetic |
| 3363 | HTXLH48 | Connective/Epithelial, Immune/Hematopoetic |
| 3364 | HTXLZ79 | Cancer |
| 3365 | HTXNL31 | Cancer |
| 3366 | HTXNV67 | Cancer |
| 3367 | HTXOZ19 | Cancer |
| 3368 | HTXQM57 | Immune/Hematopoetic, Mixed Fetal |
| 3369 | HTXRE15 | Cancer |
| 3370 | HUCNC61 | Cancer |
| 3371 | HUCNP80 | Cancer |
| 3372 | HUCPD31 | Cancer |
| 3373 | HUDAM89 | Reproductive |
| 3374 | HLFAC36 | Cancer |
| 3375 | HUFAC49 | Digestive |
| 3376 | HUFAK67 | Digestive, Immune/Hematopoetic, Reproductive |
| 3377 | HUFAT34 | Cancer |
| 3378 | HUFBC44 | Digestive, Mixed Fetal, Neural/Sensory |
| 3379 | HUFBK08 | Digestive, Musculoskeletal |
| 3380 | HUFBO40 | Digestive, Immune/Hematopoetic, Reproductive |
| 3381 | HUFGH53 | Cancer |
| 3382 | HUJBK19 | Cancer |
| 3383 | HUJCQ39 | Excretory, Immune/Hematopoetic |
| 3384 | HUKAA55 | Digestive, Immune/Hematopoetic, Reproductive |
| 3385 | HUKAM16 | Cancer |
| 3386 | HUKBH05 | Cancer |
| 3387 | HUKCD10 | Cancer |
| 3388 | HUKCO64 | Cancer |
| 3389 | HUKEX85 | Musculoskeletal, Reproductive |
| 3390 | HUKFC71 | Cancer |
| 3391 | HULAG01 | Cardiovascular |
| 3392 | HUNAB18 | Cancer |
| 3393 | HUNAE14 | Reproductive |
| 3394 | HUNAH63 | Reproductive |
| 3395 | HUSAM59 | Cancer |
| 3396 | HUSAO56 | Cancer |
| 3397 | HUSAQ05 | Cancer |
| 3398 | HUSAQ32 | Cancer |
| 3399 | HUSFE58 | Cancer |
| 3400 | HUSFF19 | Cancer |
| 3401 | HUSGC54 | Cardiovascular, Immune/Hematopoetic, Neural/Sensory |
| 3402 | HUSGT36 | Cardiovascular |
| 3403 | HUSGX69 | Cancer |
| 3404 | HUSHB62 | Cancer |
| 3405 | HUSHH92 | Cancer |
| 3406 | HUSIB13 | Cancer |
| 3407 | HUSIE23 | Cancer |
| 3408 | HUSIF44 | Cancer |
| 3409 | HUSIJ08 | Cardiovascular, Immune/Hematopoetic |
| 3410 | HUSIR91 | Cancer |
| 3411 | HUSIT18 | Cancer |
| 3412 | HUSIT49 | Cancer |
| 3413 | HUSIY89 | Cancer |
| 3414 | HUSJM25 | Cancer |
| 3415 | HUSJN32 | Cardiovascular |
| 3416 | HUSXE77 | Cancer |
| 3417 | HUSXJ64 | Cardiovascular, Reproductive |
| 3418 | HUSXU29 | Cancer |
| 3419 | HUSZS75 | Cancer |
| 3420 | HUUDF48 | Immune/Hematopoetic |
| 3421 | HUVDJ43 | Cardiovascular, Reproductive |
| 3422 | HUVDJ43 | Cardiovascular, Reproductive |
| 3423 | HUVDP63 | Cancer |
| 3424 | HUVEO77 | Reproductive |
| 3425 | HUVFB80 | Cancer |
| 3426 | HUVFH14 | Cancer |
| 3427 | HUVFY29 | Cancer |
| 3428 | HUVHI35 | Cancer |
| 3429 | HVAAE95 | Digestive |
| 3430 | HVARW53 | Digestive |

TABLE 1C-continued

| Gene No. | cDNA Clone ID: | Preferred Indications: |
|---|---|---|
| 3431 | HVVAM64 | Cancer |
| 3432 | HWAAP70 | Immune/Hematopoetic |
| 3433 | HWAAW33 | Cancer |
| 3434 | HWABC21 | Immune/Hematopoetic |
| 3435 | HWABE12 | Cancer |
| 3436 | HWABF47 | Cancer |
| 3437 | HWABI12 | Immune/Hematopoetic |
| 3438 | HWABU17 | Cancer |
| 3439 | HWABW49 | Immune/Hematopoetic |
| 3440 | HWAFG52 | Immune/Hematopoetic, Reproductive, Respiratory |
| 3441 | HWAFT87 | Cardiovascular, Immune/Hematopoetic |
| 3442 | HWAGJ85 | Cardiovascular, Immune/Hematopoetic |
| 3443 | HWAHE17 | Digestive, Immune/Hematopoetic |
| 3444 | HWBAD01 | Immune/Hematopoetic |
| 3445 | HWBAO29 | Immune/Hematopoetic, Reproductive |
| 3446 | HWBAS39 | Cancer |
| 3447 | HWBBP10 | Immune/Hematopoetic, Neural/Sensory |
| 3448 | HWBBT49 | Cancer |
| 3449 | HWBCH13 | Immune/Hematopoetic |
| 3450 | HWBCM79 | Immune/Hematopoetic |
| 3451 | HWBCN75 | Cancer |
| 3452 | HWBCV72 | Cancer |
| 3453 | HWBDI30 | Cancer |
| 3454 | HWBDM37 | Digestive, Immune/Hematopoetic, Reproductive |
| 3455 | HWBDM62 | Endocrine, Immune/Hematopoetic |
| 3456 | HWBDM68 | Immune/Hematopoetic |
| 3457 | HWBDO80 | Immune/Hematopoetic, Musculoskeletal, Reproductive |
| 3458 | HWBDV80 | Cancer |
| 3459 | HWBEV57 | Immune/Hematopoetic |
| 3460 | HWBFY57 | Digestive, Immune/Hematopoetic |
| 3461 | HWDAD17 | Cancer |
| 3462 | HWDAO37 | Cancer |
| 3463 | HWDAO40 | Cancer |
| 3464 | HWEAC77 | Connective/Epithelial |
| 3465 | HWEAD64 | Cancer |
| 3466 | HWHGZ26 | Cancer |
| 3467 | HWHHD11 | Cancer |
| 3468 | HWHIH10 | Cancer |
| 3469 | HWHIM26 | Connective/Epithelial, Immune/Hematopoetic |
| 3470 | HWHJD93 | Cancer |
| 3471 | HWHKC09 | Cancer |
| 3472 | HWHKR51 | Cancer |
| 3473 | HWHPM16 | Cancer |
| 3474 | HWHRL06 | Cancer |
| 3475 | HWHSB53 | Cancer |
| 3476 | HWHSK19 | Cancer |
| 3477 | HWHSO13 | Connective/Epithelial |
| 3478 | HWJAE49 | Connective/Epithelial, Digestive, Reproductive |
| 3479 | HWLBP46 | Cancer |
| 3480 | HWLEC41 | Cancer |
| 3481 | HWLED11 | Cancer |
| 3482 | HWLEQ37 | Cancer |
| 3483 | HWLEZ82 | Cancer |
| 3484 | HWLFE89 | Digestive, Immune/Hematopoetic |
| 3485 | HWLFJ10 | Cancer |
| 3486 | HWLFQ64 | Digestive |
| 3487 | HWLFR02 | Cancer |
| 3488 | HWLGV78 | Digestive, Immune/Hematopoetic |
| 3489 | HWLHH15 | Digestive |
| 3490 | HWLHM66 | Cancer |
| 3491 | HWLHZ28 | Cancer |
| 3492 | HWLJE21 | Cancer |
| 3493 | HWLJQ88 | Digestive |
| 3494 | HWLJX42 | Cancer |
| 3495 | HWLNF33 | Cancer |
| 3496 | HWLQU40 | Cancer |
| 3497 | HWMAF61 | Digestive |
| 3498 | HWMAH36 | Immune/Hematopoetic |
| 3499 | HWMGN33 | Digestive |
| 3500 | HWMKQ25 | Cancer |
| 3501 | HWMLN52 | Digestive, Immune/Hematopoetic |
| 3502 | HWTAD49 | Cancer |
| 3503 | HWTAL40 | Cancer |
| 3504 | HWTAW41 | Cancer |
| 3505 | HWTAZ75 | Cancer |
| 3506 | HWTBF59 | Cancer |
| 3507 | HWTBL40 | Cancer |
| 3508 | HWTBM18 | Immune/Hematopoetic, Musculoskeletal |
| 3509 | HWTBM45 | Cancer |
| 3510 | HWTCE21 | Cancer |
| 3511 | HXOAC69 | Cancer |
| 3512 | HYAAL70 | Cancer |
| 3513 | HYAAY40 | Immune/Hematopoetic |
| 3514 | HYAAY86 | Immune/Hematopoetic |
| 3515 | HYABE50 | Cancer |
| 3516 | HYACE88 | Cancer |
| 3517 | HYACI76 | Cancer |
| 3518 | HYACJ27 | Immune/1-Jematopoetic |
| 3519 | HYASC80 | Cancer |
| 3520 | HYASD09 | Cancer |
| 3521 | HYBAR26 | Musculoskeletal |
| 3522 | HYBAY77 | Immune/Hematopoetic, Musculoskeletal |
| 3523 | HZAAE52 | Cancer |

Table 1E provides information related to biological activities and preferred indications for polynucleotides and polypeptides of the invention (including antibodies, agonists, and/or antagonists thereof). Table 1E also provides information related to assays which may be used to test polynucleotides and polypeptides of the invention (including antibodies, agonists, and/or antagonists thereof) for the corresponding biological activities. The first column ("Gene No.") provides the gene number in the application for each clone identifier. The second column ("cDNA Clone ID:") provides the unique clone identifier for each clone as previously described and indicated in Tables 1A, 1B, 1C, and 1D. The third column ("AA SEQ ID NO:Y") indicates the Sequence Listing SEQ ID Number for polypeptide sequences encoded by the corresponding cDNA clones (also as indicated in Tables 1A, 1B, and 2). The fourth column ("Biological Activity") indicates a biological activity corresponding to the indicated polypeptides (or polynucleotides encoding said polypeptides). The fifth column ("Exemplary Activity Assay") further describes the corresponding biological activity and also provides information pertaining to the various types of assays which may be performed to test, demonstrate, or quantify the corresponding biological activity. The sixth column ("Preferred Indictions") describes particular embodiments of the invention as well as indications (e.g. pathologies, diseases, disorders, abnormalities, etc.) for which polynucleotides and polypeptides of the invention (including antibodies, agonists, and/or antagonists thereof) may be used in detecting, diagnosing, preventing, and/or treating.

Table 1E describes the use of, inter alia, FMAT technology for testing or demonstrating various biological activities. Fluorometric microvolume assay technology (FMAT) is a fluorescence-based system which provides a means to perform nonradioactive cell- and bead-based assays to detect activation of cell signal transduction pathways. This technology was designed specifically for ligand binding and immunological assays. Using this technology, fluorescent cells or beads at the bottom of the well are detected as localized areas of concentrated fluorescence using a data processing system. Unbound flurophore comprising the background signal is ignored, allowing for a wide variety of homogeneous assays. FMAT technology may be used for peptide ligand binding assays, immunofluorescence, apoptosis, cytotoxicity, and bead-based immunocapture assays. See, Miraglia S et. al., "Homogeneous cell and bead based assays for high throughput screening using flourometric microvolume assay technology," Journal of Biomolecular Screening; 4:193-204 (1999). In particular, FMAT technology may be used to test, confirm, and/or identify the ability of polypeptides (including polypeptide fragments and variants) to activate signal transduction pathways. For example, FMAT technology may be used to test, confirm, and/or identify the ability of polypeptides to upregulate production of immunomodulatory proteins (such as, for example, interleukins, GM-CSF, Rantes, and Tumor Necrosis factors, as well as other cellular regulators (e.g. insulin)).

Table 1E also describes the use of kinase assays for testing, demonstrating, or quantifying biological activity. In this regard, the phosphorylation and de-phosphorylation of specific amino acid residues (e.g. Tyrosine, Serine, Threonine) on cell-signal transduction proteins provides a fast, reversible means for activation and de-activation of cellular signal transduction pathways. Moreover, cell signal transduction via phosphorylation/de-phosphorylation is crucial to the regulation of a wide variety of cellular processes (e.g. proliferation, differentiation, migration, apoptosis, etc.). Accordingly, kinase assays provide a powerful tool useful for testing, confirming, and/or identifying polypeptides (including polypeptide fragments and variants) that mediate cell signal transduction events via protein phosphorylation. See e.g., Forrer, P., Tamaskovic R., and Jaussi, R. "Enzyme-Linked Immunosorbent Assay for Measurement of JNK, ERK, and p38 Kinase Activities" Biol. Chem. 379(8-9): 1101-1110 (1998).

Lengthy table referenced here

US07411051-20080812-T00004

Please refer to the end of the specification for access instructions.

Table 1F:

Polynucleotides encoding polypeptides of the present invention can be used in assays to test for one or more biological activities. One such biological activity which may be tested includes the ability of polynucleotides and polypeptides of the invention to stimulate up-regulation or down-regulation of expression of particular genes and proteins. Hence, if polynucleotides and polypeptides of the present invention exhibit activity in altering particular gene and protein expression patterns, it is likely that these polynucleotides and polypeptides of the present invention may be involved in, or capable of effecting changes in, diseases associated with the altered gene and protein expression profiles. Hence, polynucleotides, polypeptides, or antibodies of the present invention could be used to treat said associated diseases.

TAQMAN® assays may be performed to assess the ability of polynucleotides (and polypeptides they encode) to alter the expression pattern of particular "target" genes. TAQMAN® reactions are performed to evaluate the ability of a test agent to induce or repress expression of specific genes in different cell types. TAQMAN® gene expression quantification assays ("TAQMAN® assays") are well known to, and routinely performed by, those of ordinary skill in the art. TAQMAN® assays are performed in a two step reverse transcription/polymerase chain reaction (RT-PCR). In the first (RT) step, cDNA is reverse transcribed from total RNA samples using random hexamer primers. In the second (PCR) step, PCR products are synthesized from the cDNA using gene specific primers.

To quantify gene expression the TAQMAN® PCR reaction exploits the 5' nuclease activity of AMPLITAQ GOLD® DNA Polymerase to cleave a TAQMAN® probe (distinct from the primers) during PCR. The TAQMAN® probe contains a reporter dye at the 5'-end of the probe and a quencher dye at the 3' end of the probe. When the probe is intact, the proximity of the reporter dye to the quencher dye results in suppression of the reporter fluorescence. During PCR, if the target of interest is present, the probe specifically anneals between the forward and reverse primer sites. AMPLITAQ GOLD® DNA Polymerase then cleaves the probe between the reporter and quencher when the probe hybridizes to the target, resulting in increased fluorescence of the reporter (see FIG. 2). Accumulation of PCR products is detected directly by monitoring the increase in fluorescence of the reporter dye.

After the probe fragments are displaced from the target, polymerization of the strand continues. The 3'-end of the probe is blocked to prevent extension of the probe during PCR. This process occurs in every cycle and does not interfere with the exponential accumulation of product. The increase in fluorescence signal is detected only if the target sequence is complementary to the probe and is amplified during PCR. Because of these requirements, any nonspecific amplification is not detected.

For test sample preparation, vector controls or constructs containing the coding sequence for the gene of interest are transfected into cells, such as for example 293T cells, and supernatants collected after 48 hours. For cell treatment and RNA isolation, multiple primary human cells or human cell lines are used; such cells may include but are not limited to, Normal Human Dermal Fibroblasts, Aortic Smooth Muscle, Human Umbilical Vein Endothelial Cells, HepG2, Daudi, Jurkat, U937, Caco, and THP-1 cell lines. Cells are plated in growth media and growth is arrested by culturing without media change for 3 days, or by switching cells to low serum media and incubating overnight. Cells are treated for 1, 6, or 24 hours with either vector control supernatant or sample supernatant (or purified/partially purified protein preparations in buffer). Total RNA is isolated; for example, by using Trizol extraction or by using the Ambion RNAQUEOUS®-4PCR RNA isolation system. Expression levels of multiple genes are analyzed using TAQMAN®, and expression in the test sample is compared to control vector samples to identify genes induced or repressed. Each of the above described techniques are well known to, and routinely performed by, those of ordinary skill in the art.

Table 1F indicates particular disease classes and preferred indications for which polynucleotides, polypeptides, or antibodies of the present invention may be used in detecting, diagnosing, preventing, treating and/or ameliorating said diseases and disorders based on "target" gene expression patterns which may be up- or down-regulated by polynucleotides (and the encoded polypeptides) corresponding to each indicated cDNA Clone ID (shown in Table 1F, Column 2).

Thus, in preferred embodiments, the present invention encompasses a method of detecting, diagnosing, preventing, treating, and/or ameliorating a disease or disorder listed in the "Disease Class" and/or "Preferred Indication" columns of Table 1F; comprising administering to a patient in which such detection, diagnosis, prevention, or treatment is desired a protein, nucleic acid, or antibody of the invention (or fragment or variant thereof) in an amount effective to detect, diagnose, prevent, treat, or ameliorate the disease or disorder. The first and second columns of Table 1D show the "Gene No." and "cDNA Clone ID No.", respectively, indicating certain nucleic acids and proteins (or antibodies against the same) of the invention (including polynucleotide, polypeptide, and antibody fragments or variants thereof) that may be used in detecting, diagnosing, preventing, treating, or ameliorating the disease(s) or disorder(s) indicated in the corresponding row in the "Disease Class" or "Preferred Indication" Columns of Table 1F.

In another embodiment, the present invention also encompasses methods of detecting, diagnosing, preventing, treating, or ameliorating a disease or disorder listed in the "Disease Class" or "Preferred Indication" Columns of Table 1F; comprising administering to a patient combinations of the proteins, nucleic acids, or antibodies of the invention (or fragments or variants thereof), sharing similar indications as shown in the corresponding rows in the "Disease Class" or "Preferred Indication" Columns of Table 1F.

The "Disease Class" Column of Table 1F provides a categorized descriptive heading for diseases, disorders, and/or conditions (more fully described below) that may be detected, diagnosed, prevented, treated, or ameliorated by a protein, nucleic acid, or antibody of the invention (or fragment or variant thereof).

The "Preferred Indication" Column of Table 1F describes diseases, disorders, and/or conditions that may be detected, diagnosed, prevented, treated, or ameliorated by a protein, nucleic acid, or antibody of the invention (or fragment or variant thereof).

The "Cell Line" and "Exemplary Targets" Columns of Table 1F indicate particular cell lines and target genes, respectively, which may show altered gene expression patterns (i.e., up- or down-regulation of the indicated target gene) in TAQMAN® assays, performed as described above, utilizing polynucleotides of the cDNA Clone ID shown in the corresponding row. Alteration of expression patterns of the indicated "Exemplary Target" genes is correlated with a particular "Disease Class" and/or "Preferred Indication" as shown in the corresponding row under the respective column headings.

The "Exemplary Accessions" Column indicates GenBank Accessions (available online through the National Center for Biotechnology Information (NCBI) at www.ncbi.nim.nih.gov/) which correspond to the "Exemplary Targets" shown in the adjacent row.

The recitation of "Cancer" in the "Disease Class" Column indicates that the corresponding nucleic acid and protein, or antibody against the same, of the invention (or fragment or variant thereof) may be used for example, to detect, diagnose, prevent, treat, and/or ameliorate neoplastic diseases and/or disorders (e.g., leukemias, cancers, etc., as described below under "Hyperproliferative Disorders").

The recitation of "Immune" in the "Disease Class" column indicates that the corresponding nucleic acid and protein, or antibody against the same, of the invention (or fragment or variant thereof), may be used for example, to detect, diagnose, prevent, treat, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

The recitation of "Angiogenesis" in the "Disease Class" column indicates that the corresponding nucleic acid and protein, or antibody against the same, of the invention (or fragment or variant thereof), may be used for example, to detect, diagnose, treat, prevent, and/or ameliorate diseases and/or disorders relating to neoplastic diseases (e.g., as described below under "Hyperproliferative Disorders"), diseases and/or disorders of the cardiovascular system (e.g., as described below under "Cardiovascular Disorders"), diseases and/or disorders involving cellular and genetic abnormalities (e.g., as described below under "Diseases at the Cellular Level"), diseases and/or disorders involving angiogenesis (e.g., as described below under "Anti-Angiogenesis Activity"), to promote or inhibit cell or tissue regeneration (e.g., as described below under "Regeneration"), or to promote wound healing (e.g., as described below under "Wound Healing and Epithelial Cell Proliferation").

The recitation of "Diabetes" in the "Disease Class" column indicates that the corresponding nucleic acid and protein, or antibody against the same, of the invention (or fragment or variant thereof), may be used for example, to detect, diagnose, treat, prevent, and/or ameliorate diabetes (including diabetes mellitus types I and II), as well as diseases and/or disorders associated with, or consequential to, diabetes (e.g. as described below under "Endocrine Disorders," "Renal Disorders," and "Gastrointestinal Disorders").

TABLE 1F

| Gene No. | cDNA Clone ID | Disease Class | Preferred Indications: | Cell Line | Exemplary Targets | Exemplary Accessions |
|---|---|---|---|---|---|---|
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Caco-2 cell line is a human colorectal adenocarcinoma cell line available through the ATCC ™ as cell line number HTB-37). | Caco-2 | ICAM VCAM | gb\|X06990\|HS ICAM1 gb\|A30922\|A30922 |
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound | Daudi | Vegf1 | gb\|AF024710\| AF024710 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | Healing and Epithelial Cell Proliferation." (The Daudi cell line is a human B lymphoblast cell line available through the ATCC ™ as cell line number CCL-213). | | | |
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | Vegf1 | gb|AF024710| AF024710 |
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Jurkat cell line is a human T lymphocyte cell line available through the ATCC ™ as cell line number TIB-152). | Jurkat | VCAM | gb|A30922|A3 0922 |
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (NHDF cells are normal human dermal fibroblasts). | NHDF | PAI | gb|X12701|HS ENDPAI |
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The THP-1 cell line is a human monocyte cell line available through the ATCC ™ as cell line number TIB-202). | THP1 | Vegf1 | gb|AF024710| AF024710 |
| 92 | HCHNF25 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The U937 cell line is a human monocyte cell line available through the ATCC ™ as cell line number CRL-1593.2). | U937 | VCAM | gb|A30922|A3 0922 |
| 92 | HCHNF25 | Cancer | Highly preferred indications include neoplastic diseases (e.g. cancer) such as described herein under the heading "Hyperproliferative Disordersî (particularly including, but not | AOSMC | Cyclin D2 | gb|X68452|HS CYCD2 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | limited to, cancers of muscle tissues and the cardiovascular system (e.g. heart, lungs, circulatory system)). Highly preferred embodiments of the invention include methods of preventing, detecting, diagnosing, treating and/or ameliorating cancer and hyperproliferative disorders. (AOSMC cells are aortic smooth muscle cells). | | | |
| 92 | HCHNF25 | Cancer | Highly preferred indications include neoplastic diseases (e.g. cancer) such as described herein under the heading "Hyperproliferative Disordersî (particularly including, but not limited to, cancer involving cells of the gastrointestinal tract). Highly preferred embodiments of the invention include methods of preventing, detecting, diagnosing, treating and/or ameliorating cancer and hyperproliferative disorders involving the gastrointestinal tract. (The Caco-2 cell line is a human colorectal adenocarcinoma cell line available through the ATCC ™ as cell line number HTB-37). | Caco-2 | c-fos U66469 p53 regulated | gb|BC004490| BC004490 |
| 92 | HCHNF25 | Cancer | Highly preferred indications include neoplastic diseases (e.g. cancer) such as described herein under the heading "Hyperproliferative Disordersî (particularly including, but not limited to, cancers of immune cells, such as B-cells). Highly preferred embodiments of the invention include methods of preventing, detecting, diagnosing, treating and/or ameliorating cancer and hyperproliferative disorders involving immune cells (such as B-cells). (The Daudi cell line is a human B lymphoblast cell line available through the ATCC ™ as cell line number CCL-213). | Daudi | Cyclin A1 | gb|U97680|HS U97680 |
| 92 | HCHNF25 | Cancer | Highly preferred indications include neoplastic diseases (e.g. cancer) such as described herein under the heading "Hyperproliferative Disordersî (particularly including, but not limited to, cancers involving endothelial cells). Highly preferred embodiments of the invention include methods of preventing, detecting, diagnosing, treating and/or ameliorating cancer and hyperproliferative disorders involving endothelial cells. (HUVEC cells are human umbilical vein endothelial cells). | HUVEC | Cyclin A1 Cyclin D Cyclin D2 | gb|U97680|HS U97680 gb|BC000076| BC000076 gb|X68452|HS CYCD2 |
| 92 | HCHNF25 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or ameliorating cancer and hyperproliferative disorders involving immune cells (such as T-cells). (The Jurkat cell line is a human T lymphocyte cell line available through the ATCC ™ as cell line number TIB-152). | Jurkat | DHFR p21 U66469 p53 regulated gene | gb|V00507|HS DHFR gb|BC000275| BC000275 |
| 92 | HCHNF25 | Cancer | Highly preferred indications include neoplastic diseases (e.g. cancer) such as described herein under the heading "Hyperproliferative Disordersî (particularly including, but not limited to, cancers involving cells of the hepatic system). Highly preferred embodiments of the invention include methods of preventing, detecting, diagnosing, treating and/or ameliorating cancer and hyperproliferative disorders involving cells of the hepatic system. | Liver | p21 | gb|BC000275| BC000275 |
| 92 | HCHNF25 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, | THP1 | c-fos | gb|BC004490| BC004490 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | detecting, diagnosing, treating and/or ameliorating cancer and hyperproliferative disorders involving cells of the immune system (such as monocytes). (The THP-1 cell line is a human monocyte cell line available through the ATCC ™ as cell line number TIB-202). | | | |
| 92 | HCHNF25 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The U-937 cell line is a human monocyte cell line available through the ATCC ™ as cell line number CRL-1593.2) | U937 | Cyclin A1 Cyclin D Cyclin D2 | gb|U97680|HS U97680 gb|BC000076| BC000076 gb|X68452|HS CYCD2 |
| 92 | HCHNF25 | Immune | Highly preferred indications include immunological disorders such as described herein under the heading "Immune Activity" and/or "Blood-Related Disorders" (particularly including, but not limited to, immune disorders involving the cells of the gastrointestinal tract). Highly preferred embodiments of the invention include methods of preventing, detecting, diagnosing, treating and/or ameliorating disorders of the immune system (particularly including, but not limited to, immune disorders involving cells of the gastrointestinal tract). (The Caco-2 cell line is a human colorectal adenocarcinoma cell line available through the ATCC ™ as cell line number HTB-37). | Caco-2 | CCR4 CIS3 ICAM VCAM | gb|AB023888| AB023888 gb|AB006967| AB006967 gb|X06990|HS ICAM1 gb|A30922|A3 0922 |
| 92 | HCHNF25 | Immune | Highly preferred indications include immunological disorders such as described herein under the heading "Immune Activity" and/or "Blood-Related Disorders" (particularly including, but not limited to, immune disorders involving the B-cells). Highly preferred embodiments of the invention include methods of preventing, detecting, diagnosing, treating and/or ameliorating disorders of the immune system (particularly including, but not limited to, immune disorders involving B-cells). (The Daudi cell line is a human B lymphoblast cell line available through the ATCC ™ as cell line number CCL-213). | Daudi | Rag1 Rag2 | gb|M29474|H UMRAG1 gb|AY011962| AY011962 |
| 92 | HCHNF25 | Immune | Highly preferred indications include immunological disorders such as described herein under the heading "Immune Activity" and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | HUVEC | CD25 TNF | gb|X03137|HS IL2RG7 gb|AJ270944| HSA27094 |
| 92 | HCHNF25 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Jurkat cell line is a human T lymphocyte cell line available through the ATCC ™ as cell line number TIB-152). | Jurkat | CD28 IL2 VCAM | gb|AF222342| AF222342 gb|X61155|HS ARTIL2 gb|A30922|A3 0922 |

TABLE 1F-continued

| Gene No. | cDNA Clone ID | Disease Class | Preferred Indications: | Cell Line | Exemplary Targets | Exemplary Accessions |
|---|---|---|---|---|---|---|
| 92 | HCHNF25 | Immune | Highly preferred indications include immunological disorders such as described herein under the heading "Immune Activity" and/or "Blood-Related Disorders" (particularly including, but not limited to, immune disorders involving cells of the hepatic system). Highly preferred embodiments of the invention include methods of preventing, detecting, diagnosing, treating and/or ameliorating disorders of the immune system (particularly including, but not limited to, immune disorders involving cells of the hepatic system). | Liver | CCR4 CD28 CXCR3 Rag2 | gb\|AB023888\| AB023888 gb\|AF222342\| AF222342 gb\|Z79783\|HSCKRL2 gb\|AY011962\| AY011962 |
| 92 | HCHNF25 | Immune | Highly preferred indications include immunological disorders such as described herein under the heading "Immune Activity" and/or "Blood-Related Disorders" (particularly including, but not limited to, immune disorders involving the skin). Highly preferred embodiments of the invention include methods of preventing, detecting, diagnosing, treating and/or ameliorating disorders of the immune system (particularly including, but not limited to, immune disorders involving the skin). (NHDF cells are normal human dermal fibroblasts). | NHDF | CIS3 Rag1 | gb\|AB006967\| AB006967 gb\|M29474\|HUMRAG1 |
| 92 | HCHNF25 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The THP1 cell line is a human monocyte cell line available through the ATCC ™ as cell line number TIB-202). | THP1 | CD28 CIS3 CXCR3 | gb\|AF222342\| AF222342 gb\|AB006967\| AB006967 gb\|Z79783\|HSCKRL2 |
| 92 | HCHNF25 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | TNF VCAM | gb\|AJ270944\| HSA27094 gb\|A30922\|A30922 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (AOSMC cells are aortic smooth muscle cells). | AOSMC | Flt1 VCAM | gb\|AF063657\| AF063657 gb\|A30922\|A30922 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound | Caco-2 | Vegf1 | gb\|AF024710\| AF024710 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | Healing and Epithelial Cell Proliferation." (The Caco-2 cell line is a human colorectal adenocarcinoma cell line available through the ATCC ™ as cell line number HTB-37). | | | |
| 122 | HDPBQ71 | Angiogenesis | Highly preferred indications include diagnosis, prevention, treatment, anchor amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Daudi cell line is a human B lymphoblast cell line available through the ATCC ™ as cell line number CCL-213). | Daudi | ICAM | gb|X06990|HS ICAM1 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The HEK293 cell line is a human embryonal kidney epithelial cell line available through the ATCC ™ as cell line number CRL-1573). | HEK293 | Cycloox Flt1 iNOS | gb|AF063657| AF063657 gb|X85761|HS NOS2E3 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | Flt1 TSP-1 VCAM | gb|AF063657| AF063657 gb|X04665|HS THROMR gb|A30922|A3 0922 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Jurkat cell line is a human T lymphocyte cell line available through the ATCC ™ as cell line number TIB-152). | Jurkat | Flt1 Vegf1 | gb|AF063657| AF063657 gb|AF024710| AF024710 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." | Liver | VCAM | gb|A30922|A3 0922 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and | NHDF | TSP-1 Vegf1 | gb|X04665|HS THROMR gb|AF024710| AF024710 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | disorders; as described herein under the headings "Hyperproliferative Disorders," "Regeneration," "Anti-Angiogenesis Activity," "Diseases at the Cellular Level," and "Wound Healing and Epithelial Cell Proliferation." (NHDF cells are normal human dermal fibroblasts). | | | |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." | T cell | ICAM Vegf1 | gb\|X06990\|HS ICAM1 gb\|AF024710\| AF024710 |
| 122 | HDPBQ71 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The THP-1 cell line is a human monocyte cell line available through the ATCC ™ as cell line number TIB-202). | THP1 | VCAM | g\|A30922\|A3 0922 |
| 122 | HDPBQ71 | Angiogenesis | Highly preferred indications include diagnosis prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The U937 cell line is a human monocyte cell line available through the ATCC ™ as cell line number CRL-1593.2). | U937 | VCAM | gb\|A30922\|A3 0922 |
| 122 | HDPBQ71 | Cancer | Highly preferred indications include neoplastic diseases (e.g. cancer) such as described herein under the heading "Hyperproliferative Disordersî (particularly including, but not limited to, cancer involving cells of the gastrointestinal tract). Highly preferred embodiments of the invention include methods of preventing, detecting, diagnosing, treating and/or ameliorating cancer and hyperproliferative disorders involving the gastrointestinal tract. (The Caco-2 cell line is a human colorectal adenocarcinoma cell line available through the ATCC ™ as cell line number HTB-37). | Caco-2 | p21 TAA6 | gb\|BC000275\| BC000275 gb\|I34297\|I342 97 |
| 122 | HDPBQ71 | Cancer | Highly preferred indications include neoplastic diseases (e.g. cancer) such as described herein under the heading "Hyperproliferative Disordersî (particularly including, but not limited to, cancers of immune cells, such as B-cells). Highly preferred embodiments of the invention include methods of preventing, detecting, diagnosing, treating and/or ameliorating cancer and hyperproliferative disorders involving immune cells (such as B-cells). (The Daudi cell line is a human B lymphoblast cell line available through the ATCC ™ as cell line number CCL-213). | Daudi | Cyclin D2 | gb\|X68452\|HS CYCD2 |
| 122 | HDPBQ71 | Cancer | Highly preferred indications include neoplastic diseases (e.g. cancer) such as described herein under the heading "Hyperproliferative | HEK293 | c-jun DHFR U66469 p53 | gb\|BC006175\| BC006175 gb\|V00507\|HS |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | Disordersî (particularly including, but not limited to, cancers of epithelial cells or cancers involving the renal system). Highly preferred embodiments of the invention include methods of preventing, detecting, diagnosing, treating and/or ameliorating cancer and hyperproliferative disorders involving epithelial cells or the renal system. (The 293 cell line human embryonal kidney epithelial cell line available through the ATCC ™ as cell line number CRL-1573). | | regulated gene | DHFR |
| 122 | HDPBQ71 | Cancer | Highly preferred indications include neoplastic diseases (e.g. cancer) such as described herein under the heading "Hyperproliferative Disordersî (particularly including, but not limited to, cancers involving endothelial cells). Highly preferred embodiments of the invention include methods of preventing, detecting, diagnosing, treating and/or ameliorating cancer and hyperproliferative disorders involving endothelial cells. (HUVEC cells are human umbilical vein endothelial cells). | HUVEC | beta-catenin Cyclin A1 Cyclin D2 | gb\|U97680\|HS U97680 gb\|X68452\|HS CYCD2 |
| 122 | HDPBQ71 | Cancer | Highly preferred indications include neoplastic diseases (e.g. cancer) such as described herein under the heading "Hyperproliferative Disordersî (particularly including, but not limited to, cancers involving cells of the hepatic system). Highly preferred embodiments of the invention include methods of preventing, detecting, diagnosing, treating and/or ameliorating cancer and hyperproliferative disorders involving cells of the hepatic system. | Liver | Cyclin D3 | gb\|AR034832\| AR034832 |
| 122 | HDPBQ71 | Cancer | Highly preferred indications include neoplastic diseases (e.g. cancer) such as described herein under the heading "Hyperproliferative Disordersî (particularly including, but not limited to cancers involving cells of the skin). Highly preferred embodiments of the invention include methods of preventing, detecting, diagnosing, treating and/or ameliorating cancer and hyperproliferative disorders involving skin cells. (NHDF cells are normal human dermal fibroblasts). | NHDF | bcl-2 beta-catenin Cyclin D3 DHFR M1 RIBO R U66469 p53 regulated gene | gb\|X06487\|HS BCL2IG gb\|AR034832\| AR034832 gb\|V00507\|HS DHFR gb\|X59543\|HS RIREM1 |
| 122 | HDPBQ71 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or ameliorating cancer and hyperproliferative disorders involving cells of the immune system (such as T-cells). | T cell | Cyclin D DHFR M1 RIBO R p21 | gb\|BC000076\| BC000076 gb\|V00507\|HS DHFR gb\|X59543\|HS RIREM1 gb\|BC000275\| BC000275 |
| 122 | HDPBQ71 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The THP-1 cell line is a human monocyte cell line available through the ATCC ™ as cell line number TIB-202). | THP1 | Cyclin A1 Cyclin D2 | gb\|U97680\|HS U97680 gb\|X68452\|HS CYCD2 |
| 122 | HDPBQ71 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative | U937 | Cyclin A1 Cyclin D p21 | gb\|U97680\|HS U97680 gb\|BC000076\| BC000076 gb\|BC000275\| BC000275 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | disorders involving cells of the immune system (such as monocytes). (The U-937 cell line is a human monocyte cell line available through the ATCC ™ as cell line number CRL-1593.2) | | | |
| 122 | HDPBQ71 | Immune | Highly preferred indications include immunological disorders such as described herein under the heading "Immune Activity" and/or "Blood-Related Disorders" (particularly including, but not limited to, immune disorders involving muscle tissues and the cardiovascular system (e.g. heart, lungs, circulatory system)). Highly preferred embodiments of the invention include methods of preventing, detecting, diagnosing, treating and/or ameliorating disorders of the immune system (particularly including, but not limited to, immune disorders involving muscle tissue or the cardiovascular system). (AOSMC cells are human aortic smooth muscle cells). | AOSMC | IL1B VCAM | gb\|X02532\|HS IL1BR gb\|A30922\|A30922 |
| 122 | HDPBQ71 | Immune | Highly preferred indications include immunological disorders such as described herein under the heading "Immune Activity" and/or "Blood-Related Disorders" (particularly including, but not limited to, immune disorders involving the B-cells). Highly preferred embodiments of the invention include methods of preventing, detecting, diagnosing, treating and/or ameliorating disorders of the immune system (particularly including, but not limited to, immune disorders involving B-cells). (The Daudi cell line is a human B lymphoblast cell line available through the ATCC ™ as cell line number CCL-213). | Daudi | c-maf CD25 CXCR3 Granzyme B ICAM | gb\|AF055377\| AF055377 gb\|X03137\|HS IL2RG7 gb\|Z79783\|HS CKRL2 gb\|J04071\|HU MCSE gb\|X06990\|HS ICAM1 |
| 122 | HDPBQ71 | Immune | Highly preferred indications include immunological disorders such as described herein under the heading "Immune Activity" and/or "Blood-Related Disorders" (particularly including, but not limited to, immune disorders involving epithelial cells or the renal system). Highly preferred embodiments of the invention include methods of preventing, detecting, diagnosing, treating and/or ameliorating disorders of the immune system (particularly including, but not limited to, immune disorders involving epithelial cells or the renal system). (The 293 cell line is a human embryonal kidney epithelial cell line available through the ATCC ™ as cell line number CRL-1573). | HEK293 | CCR4 TNF | gb\|AB023888\| AB023888 gb\|AJ270944\| HSA27094 |
| 122 | HDPBQ71 | Immune | Highly preferred indications include immunological disorders such as described herein under the heading "Immune Activity" and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | HUVEC | Rag2 VCAM | gb\|AY011962\| AY011962 gb\|A30922\|A30922 |
| 122 | HDPBQ71 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Jurkat cell line is a human T lymphocyte cell line available through the ATCC ™ as cell line number TIB-152). | Jurak | c-maf CD69 TNF | gb\|AF055377\| AF055377 gb\|Z22576\|HS CD69GNA gb\|AJ270944\| HSA27094 |

TABLE 1F-continued

| Gene No. | cDNA Clone ID | Disease Class | Preferred Indications: | Cell Line | Exemplary Targets | Exemplary Accessions |
|---|---|---|---|---|---|---|
| 122 | HDPBQ71 | Immune | Highly preferred indications include immunological disorders such as described herein under the heading "Immune Activity" and/or "Blood-Related Disorders" (particularly including, but not limited to, immune disorders involving cells of the hepatic system). Highly preferred embodiments of the invention include methods of preventing, detecting, diagnosing, treating and/or ameliorating disorders of the immune system (particularly including, but not limited to, immune disorders involving cells of the hepatic system). | Liver | VCAM | gb|A30922|A30922 |
| 122 | HDPBQ71 | Immune | Highly preferred indications include immunological disorders such as described herein under the heading "Immune Activity" and/or "Blood-Related Disorders" (particularly including, but not limited to, immune disorders involving the skin). Highly preferred embodiments of the invention include methods of preventing, detecting, diagnosing, treating and/or ameliorating disorders of the immune system (particularly including, but not limited to, immune disorders involving the skin). (NHDF cells are normal human dermal fibroblasts). | NHDF | HLA-c LTBR Rag1 | gb|AK027080| AK027080 gb|M29474|HUMRAG1 |
| 122 | HDPBQ71 | Immune | Highly preferred indications include immunological disorders such as described herein under the heading "Immune Activity" and/or "Blood-Related Disorders" (particularly including, but not limited to, immune disorders involving the central nervous system). Highly preferred embodiments of the invention include methods of preventing, detecting, diagnosing, and/or ameliorating disorders of the immune system (particularly including, but not limited to, immune disorders involving the central nervous system). (The SK-N-MC neuroblastoma cell line is a cell line derived from human brain tissue and is available through the ATCC ™ as cell line number HTB-10). | SK-N-MC neuroblastoma | CD40 TNF | gb|AJ300189| HSA30018 gb|AJ270944| HSA27094 |
| 122 | HDPBQ71 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). | T cell | CD69 CTLA4 Granzyme B ICAM IFNg IL5 LTBR Rag2 | gb|Z22576|HSCD69GNA gb|AF316875| AF316875 gb|J04071|HUMSCE gb|X06990|HSICAM1 gb|X87308|HSRNAIG gb|X12705|HSBCDFIA gb|AK027080| AK027080 gb|AY011962| AY011962 |
| 122 | HDPBQ71 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The THP1 cell line is a human monocyte cell line available through the ATCC ™ as cell line number TIB-202). | THP1 | CCR3 CD30 Il6 Rag2 VCAM | gb|AB023887| AB023887 gb|X04403|HS26KDAR gb|AY011962| AY011962 gb|A30922|A30922 |
| 122 | HDPBQ71 | Immune | Highly preferred indications include immunological disorders such as described herein under the heading "Immune Activity" and/or "Blood-Related Disorders" (particularly including, but not limited to, immune disorders | U937 | CD69 TNF VCAM | gb|Z22576|HSCF69GNA gb|AJ270944| HSA27094 gb|A30922|A3 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | | | 0922 |
| 219 | HFCCQ50 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The TF-1 cell line is a human erythroblast cell line available through the ATCC ™ as cell line number CRL-2003). | TF-1 | TSP-1 | gb\|X04665\|HS THROMR |
| 219 | HFCCQ50 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The U937 cell line is a human monocyte cell line available through the ATCC ™ as cell line number CRL-1593.2). | U937 | ICAM | gb\|X06990\|HS ICAM1 |
| 219 | HFCCQ50 | Cancer | Highly preferred indications include neoplastic diseases (e.g. cancer) such as described herein under the heading "Hyperproliferative Disordersî (particularly including, but not limited to cancers involving erythrocytes). Highly preferred embodiments of the invention include methods of preventing, detecting, diagnosing, treating and/or ameliorating cancer and hyperproliferative disorders involving erythrocytes. (The TF-1 cell line is a human erythroblast cell line available through the ATCC ™ as cell line number CRL-2003). | TF-1 | Cyclin D2 M1 RIBO R | gb\|X68452\|HS CYCD2 gb\|X59543\|HS RIREM1 |
| 219 | HFCCQ50 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (THe U-937 cell line is a human monocyte cell line available through the ATCC ™ as cell line number CRL-1593.2) | U937 | Bax DHFR M1 RIBO R | gb\|AF250190\| AF250190 gb\|V00507\|HS DHFR gb\|X59543\|HS RIREM1 |
| 219 | HFCCQ50 | Immune | Highly preferred indications include immunological disorders such as described herein under the heading "Immune Activity" and/or "Blood-Related Disorders" (particularly including, but not limited to, immune disorders involving erythrocytes). Highly preferred embodiments of the invention include methods of preventing, detecting, diagnosing, treating and/or ameliorating disorders of the immune system (particularly including, but not limited to, immune disorders involving erythrocytes). (The TF-1 cell line is a human erythroblast cell line available through the ATCC ™ as cell line number CRL-2003). | TF-1 | CD40 CD69 | gb\|AJ300189\| HSA30018 gb\|Z22576\|HS CD69GNA |

TABLE 1F-continued

| Gene No. | cDNA Clone ID | Disease Class | Preferred Indications: | Cell Line | Exemplary Targets | Exemplary Accessions |
|---|---|---|---|---|---|---|
| 219 | HFCCQ50 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | ICAM IRF1 LTBR | gb\|X06990\|HS ICAM1 gb\|X14454\|HS IRF1 gb\|AK027080\| AK027080 |
| 309 | HKACD58 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (AOSMC cells are aortic smooth muscle cells). | AOSMC | VCAM Vegf1 | gb\|A30922\|A3 0922 gb\|AF024710\| AF024710 |
| 309 | HKACD58 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The HEK293 cell line is a human embryonal kidney epithelial cell line available through the ATCC ™ as cell line number CRL-1573). | HEK293 | TSP-1 Vegf1 | gb\|X04665\|HS THROMR gb\|AF024710\| AF024710 |
| 309 | HKACD58 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | ICAM | gb\|X06990\|HS ICAM1 |
| 309 | HKACD58 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (NHDF cells are normal human dermal fibroblasts). | NHDF | VCAM | gb\|A30922\|A3 0922 |
| 309 | HKACD58 | Cancer | Highly preferred indications include neoplastic diseases (e.g. cancer) such as described herein under the heading "Hyperproliferative Disordersî (particularly including, but not limited to, cancers of muscle tissues and the cardiovascular system (e.g. heart, lungs, circulatory system)). Highly preferred embodiments of the invention include methods of preventing, detecting, diagnosing, treating | AOSMC | Cyclin D2 | gb\|X68452\|HS CYCD2 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | and/or ameliorating cancer and hyperproliferative disorders. (AOSMC cells a aortic smooth muscle cells). | | | |
| 309 | HKACD58 | Cancer | Highly preferred indications include neoplastic diseases (e.g. cancer) such as described herein under the heading "Hyperproliferative Disordersî (particularly including, but not limited to, cancers of immune cells, such as B-cells). Highly preferred embodiments of the invention include methods of preventing, detecting, diagnosing, treating and/or ameliorating cancer and hyperproliferative disorders involving immune cells (such as B-cells). (The Daudi cell line is a human B lymphoblast cell line available through the ATCC ™ as cell line number CCL-213). | Daudi | c-jun | gb|BC006175| BC006175 |
| 309 | HKACD58 | Cancer | Highly preferred indications include neoplastic diseases (e.g. cancer) such as described herein under the heading "Hyperproliferative Disordersî (particularly including, but not limited to, cancers of epithelial cells or cancers involving the renal system). Highly preferred embodiments of the invention include methods of preventing, detecting, diagnosing, treating and/or ameliorating cancer and hyperproliferative disorders involving epithelial cells or the renal system. (The 293 cell line human embryonal kidney epithelial cell line available through the ATCC ™ as cell line number CRL-1573). | HEK293 | bcl-2 DHFR p21 U66469 p53 regulated gene | gb|X06487|HS BCL2IG gb|V00507|HS DHFR gb|BC000275| BC000275 |
| 309 | HKACD58 | Cancer | Highly preferred indications include neoplastic diseases (e.g. cancer) such as described herein under the heading "Hyperproliferative Disordersî (particularly including, but not limited to, cancers involving endothelial cells). Highly preferred embodiments of the invention include methods of preventing, detecting, diagnosing, treating and/or ameliorating cancer and hyperproliferative disorders involving endothelial cells. (HUVEC cells are human umbilical vein endothelial cells). | HUVEC | U66469 p53 regulated gene | |
| 309 | HKACD58 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or ameliorating cancer and hyperproliferative disorders involving immune cells (such as T-cells). (The Jurkat cell line is a human T lymphocyte cell line available through the ATCC ™ as cell line number TIB-152). | Jurkat | Cyclin D2 | gb|X68452|HS CYCD2 |
| 309 | HKACD58 | Cancer | Highly preferred indications include neoplastic diseases (e.g. cancer) such as described herein under the heading "Hyperproliferative Disordersî (particularly including, but not limited to, cancers involving cells of the hepatic system). Highly preferred embodiments of the invention include methods of preventing, detecting, diagnosing, treating and/or ameliorating cancer and hyperproliferative disorders involving cells of the hepatic system. | Liver | Cyclin D3 Egr1 | gb|AR034832| AR034832 |
| 309 | HKACD58 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system | THP1 | Cyclin D p21 | gb|BC000076| BC000076 gb|BC000275| BC000275 |

TABLE 1F-continued

| Gene No. | cDNA Clone ID | Disease Class | Preferred Indications: | Cell Line | Exemplary Targets | Exemplary Accessions |
|---|---|---|---|---|---|---|
| 309 | HKACD58 | Cancer | (such as monocytes). (The THP-1 cell line is a human monocyte cell line available through ATCC ™ as cell line number TIB-202). Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The U-937 cell line is a human monocyte cell line available through ATCC ™ as cell line number CRL-1593.2) | U937 | c-jun Cyclin A1 | gb\|BC006175\| BC006175 gb\|U97680\|HS U97680 |
| 309 | HKACD58 | Immune | Highly preferred indications include immunological disorders such as described herein under the heading "Immune Activity" and/or "Blood-Related Disorders" (particularly including, but not limited to, immune disorders involving muscle tissues and the cardiovascular system (e.g. heart, lungs, circulatory system)). Highly preferred embodiments of the invention include methods of preventing, detecting, diagnosing, treating and/or ameliorating disorders of the immune system (particularly including, but not limited to, immune disorders involving muscle tissue or the cardiovascular system). (AOSMC cells are human aortic smooth muscle cells). | AOSMC | VCAM | gb\|A30922\|A3 0922 |
| 309 | HKACD58 | Immune | Highly preferred indications include immunological disorders such as described herein under the heading "Immune Activity" and/or "Blood-Related Disorders" (particularly including, but not limited to, immune disorders involving the B-cells). Highly preferred embodiments of the invention include methods of preventing, detecting, diagnosing, treating and/or ameliorating disorders of the immune system (particularly including, but not limited to, immune disorders involving B-cells). (The Daudi cell line is a human B lymphoblast cell line available through the ATCC ™ as cell line number CCL-213). | Daudi | CD40 | gb\|AJ300189\| HSA30018 |
| 309 | HKACD58 | Immune | Highly preferred indications include immunological disorders such as described herein under the heading "Immune Activity" and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | HUVEC | ICAM Rag1 | gb\|X06990\|HS ICAM1 gb\|M29474\|H UMRAG1 |
| 309 | HKACD58 | Immune | Highly preferred indications include immunological disorders such as described herein under the heading "Immune Activity" and/or "Blood-Related Disorders" (particularly including, but not limited to, immune disorders involving cells of the hepatic system). Highly preferred embodiments of the invention include methods of preventing, detecting, diagnosing, treating and/or ameliorating disorders of the immune system (particularly including, but not limited to, immune disorders involving cells of the hepatic system). | Liver | CD28 | gb\|AF222342\| AF222342 |
| 309 | HKACD58 | Immune | Highly preferred indications include immunological disorders such as described herein under the heading "Immune Activity" and/or "Blood-Related Disorders" (particularly including, but not limited to, immune disorders involving the skin). Highly preferred | NHDF | CXCR3 GATA1 Il6 VCAM | gb\|Z79783\|HS CKRL2 gb\|X17254\|HS ERYF1 gb\|X04403\|HS 26KDAR |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | embodiments of the invention include methods of preventing, detecting, diagnosing, treating and/or ameliorating disorders of the immune system (particularly including, but not limited to, immune disorders involving the skin). (NHDF cells are normal human dermal fibroblasts). | | | gb|A30922|A30922 |
| 309 | HKACD58 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The THP1 cell line is a human monocyte cell line available through the ATCC ™ as cell line number TIB-202). | THP1 | CIS3 | gb|AB006967|AB006967 |
| 309 | HKACD58 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | CD69 TNF | gb|Z22576|HSCD69GNA gb|AJ270944|HSA27094 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (AOSMC cells are aortic smooth muscle cells). | AOSMC | VCAM | gb|A30922|A30922 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Caco-2 cell line is a human colorectal adenocarcinoma cell line available through the ATCC ™ as cell line number HTB-37). | Caco-2 | ICAM Vegf1 | gb|X06990|HSICAM1 gb|AF024710|AF024710 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The HEK293 cell line is a human embryonal kidney epithelial cell line available through the ATCC ™ as cell line number CRL-1573). | HEK293 | Cycloox VCAM | gb|A30922|A30922 |

TABLE 1F-continued

| Gene No. | cDNA Clone ID | Disease Class | Preferred Indications: | Cell Line | Exemplary Targets | Exemplary Accessions |
|---|---|---|---|---|---|---|
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | ICAM Vegf1 | gb\|X06990\|HS ICAM1 gb\|AF024710\| AF024710 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Jurkat cell line is a human T lymphocyte cell line available through the ATCC ™ as cell line number TIB-152). | Jurkat | Flt1 | gb\|AF063657\| AF063657 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Molt4 cell line is a human T cell line available through the ATCC ™ as cell line number CRL-1582). | Molt4 | iNOS | gb\|X85761\|HS NOS2E3 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (NHDF cells are normal human dermal fibroblasts). | NHDF | Vegf1 | gb\|AF024710\| AF024710 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (SUPT cells are human T-cells). | SUPT | VCAM | gb\|A30922\|A3 0922 |
| 566 | HSDSB09 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound | THP1 | ICAM TSP-1 VCAM Vegf1 | gb\|X06990\|HS ICAM1 gb\|X04665\|HS THROMR gb\|A30922\|A3 0922 gb\|AF024710\| AF024710 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | Healing and Epithelial Cell Proliferation." (The THP-1 cell line is a human monocyte cell line available through the ATCC ™ as cell line number TIB-202). | | | |
| 566 | HSDSB09 | Cancer | Highly preferred indications include neoplastic diseases (e.g. cancer) such as described herein under the heading "Hyperproliferative Disordersî (particularly including, but not limited to, cancers of muscle tissues and the cardiovascular system (e.g. heart, lungs, circulatory system)). Highly preferred embodiments of the invention include methods of preventing, detecting, diagnosing, treating and/or ameliorating cancer and hyperproliferative disorders. (AOSMC cells are aortic smooth muscle cells). | AOSMC | bcl-2 Cyclin A1 M1 RIBO R | gb\|X06487\|HS BCL2IG gb\|U97680\|HS U97680 gb\|X59543\|HS RIREM1 |
| 566 | HSDSB09 | Cancer | Highly preferred indications include neoplastic diseases (e.g. cancer) such as described herein under the heading "Hyperproliferative Disordersî (particularly including, but not limited to, cancer involving cells of the gastrointestinal tract). Highly preferred embodiments of the invention include methods of preventing, detecting, diagnosing, treating and/or ameliorating cancer and hyperproliferative disorders involving the gastrointestinal tract. (The Caco-2 cell line is a human colorectal adenocarcinoma cell line available through the ATCC ™ as cell line number HTB-37). | Caco-2 | DHFR Egr1 p53 U66469 p53 regulated gene | gb\|V00507\|HS DHFR gb\|X60011\|HS P53002 |
| 566 | HSDSB09 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or ameliorating cancer and hyperproliferative disorders involving immune cells (such as T-cells). (The H9 cell line is a human T lymphocyte cell line available through the ATCC ™ as cell line number HTB-176). | H9 | DHFR U66469 p53 regulated gene | gb\|V00507\|HS DHFR |
| 566 | HSDSB09 | Cancer | Highly preferred indications include neoplastic diseases (e.g. cancer) such as described herein under the heading "Hyperproliferative Disordersî (particularly including, but not limited to, cancers of epithelial cells or cancers involving the renal system). Highly preferred embodiments of the invention include methods of preventing, detecting, diagnosing, treating and/or ameliorating cancer and hyperproliferative disorders involving epithelial cells or the renal system. (The 293 cell line human embryonal kidney epithelial cell line available through the ATCC ™ as cell line number CRL-1573). | HEK293 | bcl-2 Cyclin D E-cadherin M1 RIBO R | gb\|X06487\|HS BCL2IG gb\|BC000076\| BC000076 gb\|Z35408\|HS ECDA9 gb\|X59543\|HS RIREM1 |
| 566 | HSDSB09 | Cancer | Highly preferred indications include neoplastic diseases (e.g. cancer) such as described herein under the heading "Hyperproliferative Disordersî (particularly including, but not limited to, cancers involving endothelial cells). Highly preferred embodiments of the invention include methods of preventing, detecting, diagnosing, treating and/or ameliorating cancer and hyperproliferative disorders involving endothelial cells. (HUVEC cells are human umbilical vein endothelial cells). | HUVEC | Cyclin D2 | gb\|X68452\|HS CYCD2 |
| 566 | HSDSB09 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or | Jurkat | Cyclin A1 Cyclin D Cyclin D2 Cyclin D3 DHFR Egr1 | gb\|U97680\|HS U97680 gb\|BC000076\| BC000076 gb\|X68452\|HS CYCD2 gb\|AR034832\| AR034832 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | ameliorating cancer and hyperproliferative disorders involving immune cells (such as T-cells). (The Jurkat cell line is a human T lymphocyte cell line available through the ATCC ™ as cell line number TIB-152). | | | gb|V00507|HS DHFR |
| 566 | HSDSB09 | Cancer | Highly preferred indications include neoplastic diseases (e.g. cancer) such as described herein under the heading "Hyperproliferative Disordersî (particularly including, but not limited to, cancers involving cells of the hepatic system). Highly preferred embodiments of the invention include methods of preventing, detecting, diagnosing, treating and/or ameliorating cancer and hyperproliferative disorders involving cells of the hepatic system. | Liver | Cyclin D2 DHFR | gb|X68452|HS CYCD2 gb|V00507|HS DHFR |
| 566 | HSDSB09 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or ameliorating cancer and hyperproliferative disorders involving immune cells (such as T-cells). (The Molt-4 cell line is a human T-cell line available through the ATCC ™ as cell line number CRL-1582). | Molt4 | Cyclin D2 p21 | gb|X68452|HS CYCD2 gb|BC000275| BC000275 |
| 566 | HSDSB09 | Cancer | Highly preferred indications include neoplastic diseases (e.g. cancer) such as described herein under the heading "Hyperproliferative Disordersî (particularly including, but not limited to cancers involving cells of the skin). Highly preferred embodiments of the invention include methods of preventing, detecting, diagnosing, treating and/or ameliorating cancer and hyperproliferative disorders involving skin cells. (NHDF cells are normal human dermal fibroblasts). | NHDF | U66469 p53 regulated gene | |
| 566 | HSDSB09 | Cancer | Highly preferred indications include neoplastic diseases (e.g. cancer) such as described herein under the heading "Hyperproliferative Disordersî (particularly including, but not limited to cancers involving cells of the brain/central nervous system (e.g. neural epithelium)). Highly preferred embodiments of the invention include methods of preventing, detecting, diagnosing, treating and/or ameliorating cancer and hyperproliferative disorders involving the brain or central nervous system. (The SK-N-MC neuroblastoma cell line is a cell line derived from human brain tissue available through the ATCC ™ as cell line number HTB-10). | SK-N-MC neuroblastoma | Cyclin A1 Egr1 p53 U66469 p53 regulated gene | gb|U97680|HS U97680 gb|X60011|HS P53002 |
| 566 | HSDSB09 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The THP-1 cell line is a human monocyte cell line available through the ATCC ™ as cell line number TIB-202). | THP1 | Cyclin D DHFR Egr1 p21 U66469 p53 regulated gene | gb|BC000076| BC000076 gb|V00507|HS DHFR gb|BC000275| BC000275 |
| 566 | HSDSB09 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative | U937 | Egr1 | |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | disorders involving cells of the immune system (such as monocytes). (The U-937 cell line is a human monocyte cell line available through the ATCC ™as cell line number CRL-1593.2) | | | |
| 566 | HSDSB09 | Diabetes | A highly preferred indication is diabetes. Additional highly preferred indications include complications associated with diabetes (e.g., diabetic retinopathy, diabetic nephropathy, kidney disease (e.g., renal failure, nephropathy, and/or other diseases and disorders as described in the "Renal Disorders" section below), diabetic neuropathy, nerve disease and nerve damage (e.g., due to diabetic neuropathy), blood vessel blockage, heart disease, stroke, impotence (e.g., due to diabetic neuropathy or blood vessel blockage), seizures, mental confusion, drowsiness, nonketotic hyperglycemic-hyperosmolar coma, cardiovascular disease (e.g., heart disease, atherosclerosis, microvascular disease, hypertension, stroke, and other diseases and disorders as described in the "Cardiovascular Disorders" section below), dyslipidemia, endocrine disorders (as described in the "Endocrine Disorders" section below), neuropathy, vision impairment (e.g., diabetic retinopathy and blindness), ulcers and impaired wound healing, and infection (e.g., infectious diseases and disorders as described in the "Infectious Diseases" section below, especially of the urinary tract and skin). Highly preferred indications also include obesity, weight gain, and weight loss, as well as complications associated with obesity, weight gain, and weight loss. Preferred embodiments of the invention include methods of preventing, detecting, diagnosing, treating and/or ameliorating the above mentioned conditions disorders, and diseases. (AOSMC cells are aortic smooth muscle cells). | AOSMC | GAPDH | |
| 566 | HSDSB09 | Immune | Highly preferred indications include immunological disorders such as described herein under the heading "Immune Activity" and/or "Blood-Related Disorders" (particularly including, but not limited to, immune disorders involving muscle tissues and the cardiovascular system (e.g. heart, lungs, circulatory system)). Highly preferred embodiments of the invention include methods of preventing, detecting, diagnosing, treating and/or ameliorating disorders of the immune system (particularly including, but not limited to, immune disorders involving muscle tissue or the cardiovascular system). (AOSMC cells are human aortic smooth muscle cells). | AOSMC | CCR3 CCR4 CD25 CD30 CD40 CTLA4 IL5 Rag1 VACM | gb\|AB023887\| AB023887 gb\|AB023888\| AB023888 gb\|X03137\|HS IL2RG7 gb\|AJ300189\| HSA30018 gb\|AF316875\| AF316875 gb\|X12705\|HS BCDFIA gb\|M29474\|H UMRAG1 gb\|A30922\|A3 0922 |
| 566 | HSDSB09 | Immune | Highly preferred indications include immunological disorders such as described herein under the heading "Immune Activity" and/or "Blood-Related Disorders" (particularly including, but not limited to, immune disorders involving the cells of the gastrointestinal tract). Highly preferred embodiments of the invention include methods of preventing, detecting, diagnosing, treating and/or ameliorating disorders of the immune system (particularly including, but not limited to, immune disorders involving cells of the gastrointestinal tract). (The Caco-2 cell line is a human colorectal adenocarcinoma cell line available through the ATCC ™ as cell line number HTB-37). | Caco-2 | c-maf GATA3 ICAM Rag1 | gb\|AF055377\| AF055377 gb\|X55037\|HS GATA3 gb\|X06990\|HS ICAM1 gb\|M29474\|H UMRAG1 |
| 566 | HSDSB09 | Immune | Highly preferred indications include immunological disorders such as described herein under the heading "Immune Activity" and/or "Blood-Related Disorders" (particularly including, but not limited to, immune disorders | Daudi | TNF | gb\|AJ270944\| HSA27094 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | involving the B-cells). Highly preferred embodiments of the invention include methods of preventing, detecting, diagnosing, treating and/or ameliorating disorders of the immune system (particularly including, but not limited to, immune disorders involving B-cells). (The Daudi cell line is a human B lymphoblast cell line available through the ATCC ™ as cell line number CCL-213). | | | |
| 566 | HSDSB09 | Immune | Highly preferred indications include immunological disorders such as described herein under the heading "Immune Activity" and/or "Blood-Related Disorders" (particularly including, but not limited to, immune disorders involving the T-cells). Highly preferred embodiments of the invention include methods of preventing, detecting, diagnosing, treating and/or ameliorating disorders of the immune system (particularly including, but not limited to, immune disorders involving T-cells). (The H9 cell line is a human T lymphocyte cell line available through the ATCC ™ as cell line number HTB-176). | H9 | CIS3 Rag1 | gb\|AB006967\| AB006967 gb\|M29474\|H UMRAG1 |
| 566 | HSDSB09 | Immune | Highly preferred indications include immunological disorders such as described herein under the heading "Immune Activity" and/or "Blood-Related Disorders" (particularly including, but not limited to, immune disorders involving epithelial cells or the renal system). Highly preferred embodiments of the invention include methods of preventing, detecting, diagnosing, treating and/or ameliorating disorders of the immune system (particularly including, but not limited to, immune disorders involving epithelial cells or the renal system). (The 293 cell line is a human embryonal kidney epithelial cell line available through the ATCC ™ as cell line number CRL-1573). | HEK293 | CCR3 CCR4 CD25 CD30 CD40 CTLA4 GATA3 Rag1 TNF VCAM | gb\|AB023887\| AB023887 gb\|AB023888\| AB023888 gb\|X03137\|HS IL2RG7 gb\|AJ300189\| HSA30018 gb\|AF316875\| AF316875 gb\|X55037\|HS GATA3 gb\|M29474\|H UMRAG1 gb\|AJ270944\| HSA27094 gb\|A30922\|A3 0922 |
| 566 | HSDSB09 | Immune | Highly preferred indications include immunological disorders such as described herein under the heading "Immune Activity" and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | HUVEC | CD40 ICAM IL10 Rag1 Rag2 TNF | gb\|AJ300189\| HSA30018 gb\|X06990\|HS ICAM1 gb\|AF055467\| AF055467 gb\|M29474\|H UMRAG1 gb\|AY011962\| AY011962 gb\|AJ270944\| HSA27094 |
| 566 | HSDSB09 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Jurkat cell line is a human T lymphocyte cell line available through the ATCC ™ as cell line number TIB-152). | Jurkat | CD69 IL5 Rantes TNF | gb\|Z22576\|HS CD69GNA gb\|X12705\|HS BCDFIA gb\|AF043341\| AF043341 gb\|AJ270944\| HSA27094 |
| 566 | HSDSB09 | Immune | Highly preferred indications include immunological disorders such as described herein under the heading "Immune Activity" and/or "Blood-Related Disorders" (particularly including, but not limited to, immune disorders involving cells of the hepatic system). Highly preferred embodiments of the invention include methods of preventing, detecting, diagnosing, | Liver | CD25 | gb\|X03137\|HS IL2RG7 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | treating and/or ameliorating disorders of the immune system (particularly including, but not limited to, immune disorders involving cells of the hepatic system). | | | |
| 566 | HSDSB09 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Molt-4 cell line is a human T-cell line available through the ATCC ™ as cell line number CRL-1582). | Molt4 | CD28 | gb|AF222342| AF222342 |
| 566 | HSDSB09 | Immune | Highly preferred indications include immunological disorders such as described herein under the heading "Immune Activity" and/or "Blood-Related Disorders" (particularly including, but not limited to, immune disorders involving the skin). Highly preferred embodiments of the invention include methods of preventing, detecting, diagnosing, treating and/or ameliorating disorders of the immune system (particularly including, but not limited to, immune disorders involving the skin). (NHDF cells are normal human dermal fibroblasts). | NHDF | CD28 CD40 Il6 | gb|AF222342| AF222342 gb|AJ300189| HSA30018 gb|X04403|HS 26KDAR |
| 566 | HSDSB09 | Immune | Highly preferred indications include immunological disorders such as described herein under the heading "Immune Activity" and/or "Blood-Related Disorders" (particularly including, but not limited to, immune disorders involving the central nervous system). Highly preferred embodiments of the invention include methods of preventing, detecting, diagnosing, treating and/or ameliorating disorders of the immune system (particularly including, but not limited to, immune disorders involving the central nervous system). (The SK-N-MC neuroblastoma cell line is a cell line derived from human brain tissue and is available through the ATCC ™ as cell line number HTB-10). | SK-N-MC neuroblastoma | c-maf CIS3 TNF | gb|AF055377| AF055377 gb|AB006967| AB006967 gb|AJ270944| HSA27094 |
| 566 | HSDSB09 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The SUPT cell line is a human T-cell line). | SUPT | TNF VCAM | gb|AJ270944| HSA27094 gb|A30922|A3 0922 |
| 566 | HSDSB09 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The THP1 cell line is a human monocyte cell line available through the ATCC ™ as cell line number TIB-202). | THP1 | CCR3 CD40 GATA3 ICAM IL5 Rag2 VCAM | gb|AB023887| AB023887 gb|AJ300189| HSA30018 gb|X55037|HS GATA3 gb|X06990|HS ICAM1 gb|X12705|HS BCDF1A gb|AY011962| AY011962 gb|A30922|A3 0922 |
| 566 | HSDSB09 | Immune | Highly preferred indications include immunological disorders such as described herein under the heading "Immune Activity" | U937 | IL1B | gb|X02532|HS IL1BR |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | | | |
| 679 | HUKBT29 | Cancer | Highly preferred indications include neoplastic diseases (e.g. cancer) such as described herein under the heading "Hyperproliferative Disordersî (particularly including, but not limited to cancers involving erythrocytes). Highly preferred embodiments of the invention include methods of preventing, detecting, diagnosing, treating and/or ameliorating cancer and hyperproliferative disorders involving erythrocytes. (The TF-1 cell line is a human erythroblast cell line available through the ATCC ™ as cell line number CRL-2003). | TF-1 | p21 | gb|BC000275|BC000275 |
| 679 | HUKBT29 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments the invention include methods of preventing, detecting, diagnosing, treating and/or ameliorating cancer and hyperproliferative disorders involving cells of the immune system (such as monocytes). (THe U-937 cell line is a human monocyte cell line available through ATCC ™ as cell line number CRL-1593.2) | U937 | p21 | gb|BC000275|BC000275 |
| 679 | HUKBT29 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | CD69 | gb|Z22576|HS CD69GNA |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (AOSMC cells are aortic smooth muscle cells). | AOSMC | TSP-1 | gb|X04665|HS THROMR |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The | Daudi | ICAM PAI | gb|X06990|HS ICAM1 gb|X12701|HS ENDPAI |

TABLE 1F-continued

| Gene No. | cDNA Clone ID | Disease Class | Preferred Indications: | Cell Line | Exemplary Targets | Exemplary Accessions |
|---|---|---|---|---|---|---|
| 702 | HWHGZ51 | Angiogenesis | Daudi cell line is a human B lymphoblast cell line available through the ATCC ™ as cell line number CCL-213). Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The H9 cell line is a human T lymphocyte cell line available through the ATCC ™ as cell line number HTB-176). | H9 | VCAM | gb\|A30922\|A3 0922 |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The HEK293 cell line is a human embryonal kidney epithelial cell line available through the ATCC ™ as cell line number CRL-1573). | HEK293 | Flt1 iNOS | gb\|AF063657\| AF063657 gb\|X85761\|HS NOS2E3 |
| 702 | HWHGZ51 | Angiogenesis | Highly preferred indications include diagnosis, prevention, treatment, and/or amelioration of and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | Vegf1 | gb\|AF024710\| AF024710 |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." | Liver | Flt1 ICAM PAI VCAM | gb\|AF063657\| AF063657 gb\|X06990\|HS ICAM1 gb\|X12701\|HS ENDPAI gb\|A30922\|A3 0922 |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Molt4 cell line is a human T cell line available through the ATCC ™ as cell line number CRL-1582). | Molt4 | VCAM | gb\|A30922\|A3 0922 |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the | NHDF | Vegf1 | gb\|AF024710\| AF024710 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | headings "Hyperproliferative Disorders," "Regeneration," "Anti-Angiogenesis Activity," "Diseases at the Cellular Level," and "Wound Healing and Epithelial Cell Proliferation." (NHDF cells are normal human dermal fibroblasts). | | | |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The THP-1 cell line is a human monocyte cell line available through the ATCC ™ as cell line number TIB-202). | THP1 | Vegf1 | gb\|AF024710\| AF024710 |
| 702 | HWHGZ51 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The U937 cell line is a human monocyte cell line available through the ATCC ™ as cell line number CRL-1593.2). | U937 | ICAM Vegf1 | gb\|X06990\|HS ICAM1 gb\|AF024710\| AF024710 |
| 702 | HWHGZ51 | Cancer | Highly preferred indications include neoplastic diseases (e.g. cancer) such as described herein under the heading "Hyperproliferative Disordersî (particularly including, but not limited to, cancers of muscle tissues and the cardiovascular system (e.g. heart, lungs, circulatory system)). Highly preferred embodiments of the invention include methods of preventing, detecting, diagnosing, treating and/or ameliorating cancer and hyperproliferative disorders. (AOSMC cells are aortic smooth muscle cells). | AOSMC | Cyclin A1 DHFR | gb\|U97680\|HS U97680 gb\|V00507\|HS DHFR |
| 702 | HWHGZ51 | Cancer | Highly preferred indications include neoplastic diseases (e.g. cancer) such as described herein under the heading "Hyperproliferative Disordersî (particularly including, but not limited to, cancer involving cells of the gastrointestinal tract). Highly preferred embodiments of the invention include methods of preventing, detecting, diagnosing, treating and/or ameliorating cancer and hyperproliferative disorders involving the gastrointestinal tract. (The Caco-2 cell line is a human colorectal adenocarcinoma cell line available through the ATCC ™ as cell line number HTB-37). | Caco-2 | c-fos Cyclin A1 | gb\|BC004490\| BC004490 gb\|U97680\|HS U97680 |
| 702 | HWHGZ51 | Cancer | Highly preferred indications include neoplastic diseases (e.g. cancer) such as described herein under the heading "Hyperproliferative Disordersî (particularly including, but not limited to, cancers of immune cells, such as B-cells). Highly preferred embodiments of the invention include methods of preventing, detecting, diagnosing, treating and/or ameliorating cancer and hyperproliferative disorders involving immune cells (such as B-cells). (The Daudi cell line is a human B lymphoblast cell line available through the ATCC ™ as cell line number CCL-213). | Daudi | Bax | gb\|AF250190\| AF250190 |
| 702 | HWHGZ51 | Cancer | Highly preferred indications include neoplastic diseases (e.g. cancer) such as described herein under the heading "Hyperproliferative | HEK293 | c-jun | gb\|BC006175\| BC006175 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | Disordersî (particularly including, but not limited to, cancers of epithelial cells or cancers involving the renal system). Highly preferred embodiments of the invention include methods of preventing, detecting, diagnosing, treating and/or ameliorating cancer and hyperproliferative disorders involving epithelial cells or the renal system. (The 293 cell line human embryonal kidney epithelial cell line available through the ATCC ™ as cell line number CRL-1573). | | | |
| 702 | HWHGZ51 | Cancer | Highly preferred indications include neoplastic diseases (e.g. cancer) such as described herein under the heading "Hyperproliferative Disordersî (particularly including, but not limited to, cancers involving endothelial cells). Highly preferred embodiments of the invention include methods of preventing, detecting, diagnosing, treating and/or ameliorating cancer and hyperproliferative disorders involving endothelial cells. (HUVEC cells are human umbilical vein endothelial cells). | HUVEC | bcl-2 TAA6 | gb\|X06487\|HS BCL2IG gb\|I34297\|I34297 |
| 702 | HWHGZ51 | Cancer | Highly preferred indications include neoplastic diseases (e.g. cancer) such as described herein under the heading "Hyperproliferative Disordersî (particularly including, but not limited to, cancers involving cells of the hepatic system). Highly preferred embodiments of the invention include methods of preventing, detecting, diagnosing, treating and/or ameliorating cancer and hyperproliferative disorders involving cells of the hepatic system. | Liver | Cyclin D3 M1 RIBO R U66469 p53 regulated gene | gb\|AR034832\| AR034832 gb\|X59543\|HS RIREM1 |
| 702 | HWHGZ51 | Cancer | Highly preferred indications include neoplastic diseases (e.g. cancer) such as described herein under the heading "Hyperproliferative Disordersî (particularly including, but not limited to cancers involving cells of the skin). Highly preferred embodiments of the invention include methods of preventing, detecting, diagnosing, treating and/or ameliorating cancer and hyperproliferative disorders involving skin cells. (NHDF cells are normal human dermal fibroblasts). | NHDF | bcl-2 TAA6 | gb\|X06487\|HS BCL2IG gb\|I34297\|I34297 |
| 702 | HWHGZ51 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The THP-1 cell line is a human monocyte cell line available through the ATCC ™ as cell line number TIB-202). | THP1 | DHFR M1 RIBO R | gb\|V00507\|HS DHFR gb\|X59543\|HS RIREM1 |
| 702 | HWHGZ51 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The U-937 cell line is a human monocyte cell line available through the ATCC ™ as cell line number CRL-1593.2) | U937 | Cyclin A1 | gb\|U97680\|HS U97680 |
| 702 | HWHGZ51 | Diabetes | A highly preferred indication is diabetes. Additional highly preferred indications include complications associated with diabetes (e.g., diabetic retinopathy, diabetic nephropathy, kidney disease (e.g., renal failure, nephropathy and/or other diseases and disorders as described in the "Renal Disorders" section below), | Liver | GAPDH | |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | diabetic neuropathy, nerve disease and nerve damage (e.g., due to diabetic neuropathy), blood vessel blockage, heart disease, stroke, impotence (e.g., due to diabetic neuropathy or blood vessel blockage), seizures, mental confusion, drowsiness, nonketotic hyperglycemic-hyperosmolar coma, cardiovascular disease (e.g., heart disease, atherosclerosis, microvascular disease, hypertension, stroke, and other diseases and disorders as described in the "Cardiovascular Disorders" section below), dyslipidemia, endocrine disorders (as described in the "Endocrine Disorders" section below), neuropathy, vision impairment (e.g., diabetic retinopathy and blindness), ulcers and impaired wound healing, and infection (e.g., infectious diseases and disorders as described in the "Infectious Diseases" section below, especially of the urinary tract and skin). Highly preferred indications also include obesity, weight gain, and weight loss, as well as complications associated with obesity, weight gain, and weight loss. Preferred embodiments of the invention include methods of preventing, detecting, diagnosing, treating and/or ameliorating the above mentioned conditions disorders, and diseases. | | | |
| 702 | HWHGZ51 | Immune | Highly preferred indications include immunological disorders such as described herein under the heading "Immune Activity" and/or "Blood-Related Disorders" (particularly including, but not limited to, immune disorders involving muscle tissues and the cardiovascular system (e.g. heart, lungs, circulatory system)). Highly preferred embodiments of the invention include methods of preventing, detecting, diagnosing, treating and/or ameliorating disorders of the immune system (particularly including, but not limited to, immune disorders involving muscle tissue or the cardiovascular system). (AOSMC cells are human aortic smooth muscle cells). | AOSMC | CD30 I16 | gb\|X04403\|HS 26KDAR |
| 702 | HWHGZ51 | Immune | Highly preferred indications include immunological disorders such as described herein under the heading "Immune Activity" and/or "Blood-Related Disorders" (particularly including, but not limited to, immune disorders involving the cells of the gastrointestinal tract). Highly preferred embodiments of the invention include methods of preventing, detecting, diagnosing, treating and/or ameliorating disorders of the immune system (particularly including, but not limited to, immune disorders involving cells of the gastrointestinal tract). (The Caco-2 cell line is a human colorectal adenocarcinoma cell line available through the ATCC ™ as cell line number HTB-37). | Caco-2 | Rag1 | gb\|M29474\|H UMRAG1 |
| 702 | HWHGZ51 | Immune | Highly preferred indications include immunological disorders such as described herein under the heading "Immune Activity" and/or "Blood-Related Disorders" (particularly including, but not limited to, immune disorders involving the B-cells). Highly preferred embodiments of the invention include methods of preventing, detecting, diagnosing, treating and/or ameliorating disorders of the immune system (particularly including, but not limited to, immune disorders involving B-cells). (The Daudi cell line is a human B lymphoblast cell line available through the ATCC ™ as cell line number CCL-213). | Daudi | CIS3 CXCR3 ICAM | gb\|AB006967\| AB006967 gb\|Z79783\|HS CKRL2 gb\|X06990\|HS ICAM1 |
| 702 | HWHGZ51 | Immune | Highly preferred indications include immunological disorders such as described herein under the heading "Immune Activity" and/or "Blood-Related Disorders" (particularly | H9 | IL5 VCAM VLA4 | gb\|X12705\|HS BCDFIA gb\|A30922\|A3 0922 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | including, but not limited to, immune disorders involving the T-cells). Highly preferred embodiments of the invention include methods of preventing, detecting, diagnosing, treating and/or ameliorating disorders of the immune system (particularly including, but not limited to, immune disorders involving T-cells). (The H9 cell line is a human T lymphocyte cell line available through the ATCC ™ as cell line number HTB-176). | | | gb|X16983|HS INTAL4 |
| 702 | HWHGZ51 | Immune | Highly preferred indications include immunological disorders such as described herein under the heading "Immune Activity" and/or "Blood-Related Disorders" (particularly including, but not limited to, immune disorders involving epithelial cells or the renal system). Highly preferred embodiments of the invention include methods of preventing, detecting, diagnosing, treating and/or ameliorating disorders of the immune system (particularly including, but not limited to, immune disorders involving epithelial cells or the renal system). (The 293 cell line is a human embryonal kidney epithelial cell line available through the ATCC ™ as cell line number CRL-1573). | HEK293 | Rag1 TNF | gb|M29474|H UMRAG1 gb|AJ270944| HSA27094 |
| 702 | HWHGZ51 | Immune | Highly preferred indications include immunological disorders such as described herein under the heading "Immune Activity" and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | HUVEC | CCR7 GATA3 TNF | gb|X84702|HS DNABLR2 gb|X55037|HS GATA3 gb|AJ270944| HSA27094 |
| 702 | HWHGZ51 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Jurkat cell line is a human T lymphocyte cell line available through the ATCC ™ as cell line number TIB-152). | Jurkat | Rag1 Rag2 | gb|M29474|H UMRAG1 gb|AY011962| AY011962 |
| 702 | HWHGZ51 | Immune | Highly preferred indications include immunological disorders such as described herein under the heading "Immune Activity" and/or "Blood-Related Disorders" (particularly including, but not limited to, immune disorders involving cells of the hepatic system). Highly preferred embodiments of the invention include methods of preventing, detecting, diagnosing, treating and/or ameliorating disorders of the immune system (particularly including, but not limited to, immune disorders involving cells the hepatic system). | Liver | CCR7 ICAM TNF VCAM | gb|X84702|HS DNABLR2 gb|X06990|HS ICAM1 gb|AJ270944| HSA27094 gb|A30922|A3 0922 |
| 702 | HWHGZ51 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Molt-4 cell line is a human T-cell line available | Molt4 | CD25 TNF VCAM | gb|X03137|HS IL2RG7 gb|AJ270944| HSA27094 gb|A30922|A3 0922 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | through the ATCC ™ as cell line number CRL-1582). | | | |
| 702 | HWHGZ51 | Immune | Highly preferred indications include immunological disorders such as described herein under the heading "Immune Activity" and/or "Blood-Related Disorders" (particularly including, but not limited to, immune disorders involving the skin). Highly preferred embodiments of the invention include methods of preventing, detecting, diagnosing, treating and/or ameliorating disorders of the immune system (particularly including, but not limited to, immune disorders involving the skin). (NHDF cells are normal human dermal fibroblasts). | NHDF | CCR7 CD40 GATA3 HLA-c TNF | gb|X84702|HS DNABLR2 gb|AJ300189| HSA30018 gb|X55037|HS GATA3 gb|AJ270944| HSA27094 |
| 702 | HWHGZ51 | Immune | Highly preferred indications include immunological disorders such as described herein under the heading "Immune Activity" and/or "Blood-Related Disorders" (particularly including, but not limited to, immune disorders involving the central nervous system). Highly preferred embodiments of the invention include methods of preventing, detecting, diagnosing, treating and/or ameliorating disorders of the immune system (particularly including, but not limited to, immune disorders involving the central nervous system). (The SK-N-MC neuroblastoma cell line is a cell line derived from human brain tissue and is available through the ATCC ™ as cell line number HTB-10). | SK-N-MC neuroblastoma | CIS3 LTBR Rag1 | gb|AB006967| AB006967 gb|AK027080| AK027080 gb|M29474|H UMRAG1 |
| 702 | HWHGZ51 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The SUPT cell line is a human T-cell line). | SUPT | CCR4 Rag1 TNF | gb|AB023888| AB023888 gb|M29474|H UMRAG1 gb|AJ270944| HSA27094 |
| 702 | HWHGZ51 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The THP1 cell line is a human monocyte cell line available through the ATCC ™ as cell line number TIB-202). | THP1 | c-maf CCR7 CXCR3 IL5 | gb|AF055377| AF055377 gb|X84702|HS DNABLR2 gb|Z79783|HS CKRL2 gb|X12705|HS BCDFIA |
| 702 | HWHGZ51 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | CD69 ICAM TNF | gb|Z22576|HS CD69GNA gb|X06990|HS ICAM1 gb|AJ270944| HSA27094 |
| 710 | HAGDG59 | Angiogenesis | Highly preferred indications include diagnosis, prevention, treatment, and/or amelioration of diseases and disorders involving angiogenesis, wound healing, neoplasia (particularly including, but not limited to, tumor | AOSMC | Vegf1 | gb|AF024710| AF024710 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (AOSMC cells are aortic smooth muscle cells). | | | |
| 710 | HAGDG59 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The HEK293 cell line is a human embryonal kidney epithelial cell line available through the ATCC ™ as cell line number CRL-1573). | HEK293 | TSP-1 | gb\|X04665\|HS THROMR |
| 710 | HAGDG59 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | Vegf1 | gb\|AF024710\| AF024710 |
| 710 | HAGDG59 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The SK-N-MC neuroblastoma cell line is a cell line derived from human brain tissue available through the ATCC ™ as cell line number HTB-10). | SK-N-MC neuroblastoma | Cycloox Vegf1 | gb\|AF024710\| AF024710 |
| 710 | HAGDG59 | Cancer | Highly preferred indications include neoplastic diseases (e.g. cancer) such as described herein under the heading "Hyperproliferative Disordersî (particularly including, but not limited to, cancer involving cells of the gastrointestinal tract). Highly preferred embodiments of the invention include methods of preventing, detecting, diagnosing, treating and/or ameliorating cancer and hyperproliferative disorders involving the gastrointestinal tract. (The Caco-2 cell line is a human colorectal adenocarcinoma cell line available through the ATCC ™ as cell line number HTB-37). | Caco-2 | M1 RIBO R p53 TAA6 | gb\|X59543\|HS RIREM1 gb\|X60011\|HS P53002 gb\|I34297\|I34297 |
| 710 | HAGDG59 | Cancer | Highly preferred indications include neoplastic diseases (e.g. cancer) such as described herein under the heading "Hyperproliferative Disordersî (particularly including, but not limited to, cancers involving endothelial cells). Highly preferred embodiments of the invention include methods of preventing, detecting, diagnosing, treating and/or ameliorating cancer and hyperproliferative disorders involving endothelial cells. (HUVEC cells are human umbilical vein endothelial cells). | HUVEC | bcl-2 Cyclin D | gb\|X06487\|HS BCL2IG gb\|BC000076\| BC000076 |

TABLE 1F-continued

| Gene No. | cDNA Clone ID | Disease Class | Preferred Indications: | Cell Line | Exemplary Targets | Exemplary Accessions |
|---|---|---|---|---|---|---|
| 710 | HAGDG59 | Cancer | Highly preferred indications include neoplastic diseases (e.g. cancer) such as described herein under the heading "Hyperproliferative Disordersî (particularly including, but not limited to cancers involving cells of the brain/central nervous system (e.g. neural epithelium)). Highly preferred embodiments of the invention include methods of preventing, detecting, diagnosing, treating and/or ameliorating cancer and hyperproliferative disorders involving the brain or central nervous system. (The SK-N-MC neuroblastoma cell line is a cell line derived from human brain tissue available through the ATCC ™ as cell line number HTB-10). | SK-N-MC neuroblastoma | Bax bcl-2 Cyclin D | gb\|AF250190\| AF250190 gb\|X06487\|HS BCL2IG gb\|BC000076\| BC000076 |
| 710 | HAGDG59 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (The U-937 cell line is a human monocyte cell line available through the ATCC ™ as cell line number CRL-1593.2) | U937 | beta-catenin Cyclin D3 DHFR M1 RIBO R | gb\|AR034832\| AR034832 gb\|V00507\|HS DHFR gb\|X59543\|HS RIREM1 |
| 710 | HAGDG59 | Immune | Highly preferred indications include immunological disorders such as described herein under the heading "Immune Activity" and/or "Blood-Related Disorders" (particularly including, but not limited to, immune disorders involving muscle tissues and the cardiovascular system (e.g. heart, lungs, circulatory system)). Highly preferred embodiments of the invention include methods of preventing, detecting, diagnosing, treating and/or ameliorating disorders of the immune system (particularly including, but not limited to, immune disorders involving muscle tissue or the cardiovascular system). (AOSMC cells are human aortic smooth muscle cells). | AOSMC | CIS3 GATA1 IL1B | gb\|AB006967\| AB006967 gb\|X17254\|HS ERYF1 gb\|X02532\|HS IL1BR |
| 710 | HAGDG59 | Immune | Highly preferred indications include immunological disorders such as described herein under the heading "Immune Activity" and/or "Blood-Related Disorders" (particularly including, but not limited to, immune disorders involving the cells of the gastrointestinal tract). Highly preferred embodiments of the invention include methods of preventing, detecting, diagnosing, treating and/or ameliorating disorders of the immune system (particularly including, but not limited to, immune disorders involving cells of the gastrointestinal tract). (The Caco-2 cell line is a human colorectal adenocarcinoma cell line available through the ATCC ™ as cell line number HTB-37). | Caco-2 | TNF | gb\|AJ270944\| HSA27094 |
| 710 | HAGDG59 | Immune | Highly preferred indications include immunological disorders such as described herein under the heading "Immune Activity" and/or "Blood-Related Disorders" (particularly including, but not limited to, immune disorders involving epithelial cells or the renal system). Highly preferred embodiments of the invention include methods of preventing, detecting, diagnosing, treating and/or ameliorating disorders of the immune system (particularly including, but not limited to, immune disorders involving epithelial cells or the renal system). (The 293 cell line is a human embryonal kidney epithelial cell line available through the ATCC ™ as cell line number CRL-1573). | HEK293 | GATA3 | gb\|X55037\|HS GATA3 |
| 710 | HAGDG59 | Immune | Highly preferred indications include immunological disorders such as described herein under the heading "Immune Activity" | HUVEC | CD30 HLA-c IL5 | gb\|X12705\|HS BCDFIA gb\|AJ270944\| |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | | TNF | HSA27094 |
| 710 | HAGDG59 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Jurkat cell line is a human T lymphocyte cell line available through the ATCC ™ as cell line number TIB-152). | Jurkat | Rag1 TNF | gb\|M29474\|H UMRAG1 gb\|AJ270944\| HSA27094 |
| 710 | HAGDG59 | Immune | Highly preferred indications include immunological disorders such as described herein under the heading "Immune Activity" and/or "Blood-Related Disorders" (particularly including, but not limited to, immune disorders involving cells of the hepatic system). Highly preferred embodiments of the invention include methods of preventing, detecting, diagnosing, treating and/or ameliorating disorders of the immune system (particularly including, but not limited to, immune disorders involving cells of the hepatic system). | Liver | LTBR | gb\|AK027080\| AK027080 |
| 710 | HAGDG59 | Immune | Highly preferred indications include immunological disorders such as described herein under the heading "Immune Activity" and/or "Blood-Related Disorders" (particularly including, but not limited to, immune disorders involving the central nervous system). Highly preferred embodiments of the invention include methods of preventing, detecting, diagnosing, treating and/or ameliorating disorders of the immune system (particularly including, but not limited to, immune disorders involving the central nervous system). (The SK-N-MC neuroblastoma cell line is a cell line derived from human brain tissue and is available through the ATCC ™ as cell line number HTB-10). | SK-N-MC neuroblastoma | CIS3 GATA1 HLA-c | gb\|AB006967\| AB006967 gb\|X17254\|HS ERYF1 |
| 710 | HAGDG59 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). | T-cell-03/31/00 | CD40 Granzyme B | gb\|AJ300189\| HSA30018 gb\|J04071\|HU MSCE |
| 710 | HAGDG59 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). | U937 | CD69 TNF | gb\|Z22576\|HS CD69GNA gb\|AJ270944\| HSA27094 |

TABLE 1F-continued

| Gene No. | cDNA Clone ID | Disease Class | Preferred Indications: | Cell Line | Exemplary Targets | Exemplary Accessions |
|---|---|---|---|---|---|---|
| 731 | HFVAB79 | Angiogenesis | (The U937 cell line is a human monocyte cell line available through the ATCC ™ as cell line number CRL-1593.2). Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The U937 cell line is a human monocyte cell line available through the ATCC ™ as cell line number CRL-1593.2). | U937 | ICAM | gb|X06990|HS ICAM1 |
| 731 | HFVAB79 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of the invention include methods of preventing, detecting, diagnosing, treating and/or ameliorating cancer and hyperproliferative disorders involving cells of the immune system (such as monocytes). (THe U-937 cell line is a human monocyte cell line available through the ATCC ™ as cell line number CRL-1593.2) | U937 | c-jun | gb|BC006175| BC006175 |
| 731 | HFVAB79 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | CTLA4 ICAM LTBR TNF | gb|AF316875| AF316875 gb|X06990|HS ICAM1 gb|AK027080| AK027080 gb|AJ270944| HSA27094 |
| 757 | HNHFO29 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The U937 cell line is a human monocyte cell line available through the ATCC ™ as cell line number CRL-1593.2). | U937 | Flt1 ICAM PAI | gb|AF063657| AF063657 gb|X06990|HS ICAM1 gb|X12701|HS ENDPAI |
| 757 | HNHFO29 | Cancer | Highly preferred indications include neoplastic diseases (e.g. cancer) such as described herein under the heading "Hyperproliferative Disordersî (particularly including, but not limited to cancers involving erythrocytes). Highly preferred embodiments of the invention include methods of preventing, detecting, diagnosing, treating and/or ameliorating cancer and hyperproliferative disorders involving erythrocytes. (The TF-1 cell line is a human erythroblast cell line available through the ATCC ™ as cell line number CRL-2003). | TF-1 | bcl-2 Cyclin D DHFR Egr1 | gb|X06487|HS BCL2IG gb|BC000076| BC000076 gb|V00507|HS DHFR |
| 757 | HNHFO29 | Cancer | Highly preferred indications include neoplastic diseases (e.g. cancer) such as described herein under the heading "Hyperproliferative Disordersî (particularly including, but not limited to, cancers of immune cells, such as monocytes). Highly preferred embodiments of | U937 | Cyclin D Cyclin D3 DHFR | gb|BC000076| BC000076 gb|AR034832| AR034832 gb|V00507|HS DHFR |

TABLE 1F-continued

| Gene No. | cDNA Clone ID | Disease Class | Preferred Indications: | Cell Line | Exemplary Targets | Exemplary Accessions |
|---|---|---|---|---|---|---|
| 757 | HNHFO29 | Immune | the invention include methods of preventing, detecting, diagnosing, treating and/or ameliorating cancer and hyperproliferative disorders involving cells of the immune system (such as monocytes). (THe U-937 cell line is a human monocyte cell line available through the ATCC ™ as cell line number CRL-1593.2) Highly preferred indications include immunological disorders such as described herein under the heading "Immune Activity" and/or "Blood-Related Disorders" (particularly including, but not limited to, immune disorders involving erythrocytes). Highly preferred embodiments of the invention include methods of preventing, detecting, diagnosing, treating and/or ameliorating disorders of the immune system (particularly including, but not limited to, immune disorders involving erythrocytes). (The TF-1 cell line is a human erythroblast cell line available through the ATCC ™ as cell line number CRL-2003). | TF-1 | CD40 TNF | gb|AJ300189| HSA30018 gb|AJ270944| HSA27094 |
| 757 | HNHFO29 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited to, immune disorders involving monocytes). (The U937 cell line is a human monocyte cell line available through the ATCC ™ as cell line number CRL-1593.2). | U937 | ICAM | gb|X06990|HS ICAM1 |
| 1630 | HFCEW05 | Cancer | Highly preferred indications include neoplastic diseases (e.g. cancer) such as described herein under the heading "Hyperproliferative Disordersî (particularly including, but not limited to cancers involving erythrocytes). Highly preferred embodiments of the invention include methods of preventing, detecting, diagnosing, treating and/or ameliorating cancer and hyperproliferative disorders involving erythrocytes. (The TF-1 cell line is a human erythroblast cell line available through the ATCC ™ as cell line number CRL-2003). | TF-1 | c-jun p21 | gb|BC006175| BC006175 gb|BC000275| BC000275 |
| 1630 | HFCEW05 | Immune | Highly preferred indications include immunological disorders such as described herein under the heading "Immune Activity" and/or "Blood-Related Disorders" (particularly including, but not limited to, immune disorders involving erythrocytes). Highly preferred embodiments of the invention include methods of preventing, detecting, diagnosing, treating and/or ameliorating disorders of the immune system (particularly including, but not limited to, immune disorders involving erythrocytes). (The TF-1 cell line is a human erythroblast cell line available through the ATCC ™ as cell line number CRL-2003). | TF-1 | CD40 IL1B LTBR | gb|AJ300189| HSA30018 gb|X02532|HS IL1BR gb|AK027080| AK027080 |
| 1950 | HJACG02 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." | Adipocytes-3/12/01 | ICAM PAI Vegf1 | gb|X06990|HS ICAM1 gb|X12701|HS ENDPAI gb|AF024710| AF024710 |
| 1950 | HJACG02 | Angiogenesis | Highly preferred indications include diagnosis, prevention, treatment, and/or amelioration of diseases and disorders involving angiogenesis, wound healing, neoplasia (particularly | AOSMC | VCAM | gb|A30922|A3 0922 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (AOSMC cells are aortic smooth muscle cells). | | | |
| 1950 | HJACG02 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (The Daudi cell line is a human B lymphoblast cell line available through the ATCC ™ as cell line number CCL-213). | Daudi | ICAM VCAM | gb|X06990|HS ICAM1 gb|A30922|A3 0922 |
| 1950 | HJACG02 | Angiogenesis | Highly preferred indications include diagnosis, prevention, treatment, and/or amelioration of diseases and disorders involving angiogenesis, wound healing, neoplasia (particularly including, but not limited to, tumor metastases), and cardiovascular diseases and disorders; as described herein under the headings "Hyperproliferative Disorders," "Regeneration," "Anti-Angiogenesis Activity," "Diseases at the Cellular Level," and "Wound Healing and Epithelial Cell Proliferation." (HUVEC cells are human umbilical vein endothelial cells). | HUVEC | ICAM TSP-1 Vegfl | gb|X06990|HS ICAM1 gb|X04665|HS THROMR gb|AF024710| AF024710 |
| 1950 | HJACG02 | Cancer | Highly preferred indications include neoplastic diseases (e.g. cancer) such as described herein under the heading "Hyperproliferative Disordersî (particularly including, but not limited to, cancer involving adipocytes). Highly preferred embodiments of the invention include methods of preventing, detecting, diagnosing, treating and/or ameliorating cancer and hyperproliferative disorders. (Primary adipocytes) | Adipocytes-3/12/01 | Egr1 | |
| 1950 | HJACG02 | Cancer | Highly preferred indications include neoplastic diseases (e.g. cancer) such as described herein under the heading "Hyperproliferative Disordersî (particularly including, but not limited to, cancers of muscle tissues and the cardiovascular system (e.g. heart, lungs, circulatory system)). Highly preferred embodiments of the invention include methods of preventing, detecting, diagnosing, treating and/or ameliorating cancer and hyperproliferative disorders. (AOSMC cells are aortic smooth muscle cells). | AOSMC | M1 RIBO R | gb|X59543|HS RIREM1 |
| 1950 | HJACG02 | Cancer | Highly preferred indications include neoplastic diseases (e.g. cancer) such as described herein under the heading "Hyperproliferative Disordersî (particularly including, but not limited to, cancers of immune cells, such as B-cells). Highly preferred embodiments of the invention include methods of preventing, detecting, diagnosing, treating and/or ameliorating cancer and hyperproliferative disorders involving immune cells (such as B-cells). (The Daudi cell line is a human B lymphoblast cell line available through the ATCC ™ as cell line number CCL-213). | Daudi | Cyclin A1 | gb|U97680|HS U97680 |
| 1950 | HJACG02 | Cancer | Highly preferred indications include neoplastic diseases (e.g. cancer) such as described herein under the heading "Hyperproliferative Disordersî (particularly including, but not limited to, cancers of epithelial cells or cancers | HEK293 | E-cadherin | gb|Z35408|HS ECAD9 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | involving the renal system). Highly preferred embodiments of the invention include methods of preventing, detecting, diagnosing, treating and/or ameliorating cancer and hyperproliferative disorders involving epithelial cells or the renal system. (The 293 cell line human embryonal kidney epithelial cell line available through the ATCC ™ as cell line number CRL-1573). | | | |
| 1950 | HJACG02 | Cancer | Highly preferred indications include neoplastic diseases (e.g. cancer) such as described herein under the heading "Hyperproliferative Disordersî (particularly including, but not limited to, cancers of immune cells, such as T-cells). Highly preferred embodiments of the invention include methods of preventing, detecting, diagnosing, treating and/or ameliorating cancer and hyperproliferative disorders involving immune cells (such as T-cells). (The Jurkat cell line is a human T lymphocyte cell line available through the ATCC ™ as cell line number TIB-152). | Jurkat | Cyclin A1 | gb|U97680|HS U97680 |
| 1950 | HJACG02 | Cancer | Highly preferred indications include neoplastic diseases (e.g. cancer) such as described herein under the heading "Hyperproliferative Disordersî (particularly including, but not limited to, cancers involving cells of the hepatic system). Highly preferred embodiments of the invention include methods of preventing, detecting, diagnosing, treating and/or ameliorating cancer and hyperproliferative disorders involving cells of the hepatic system. | Liver | Cyclin D2 | gb|X68452|HS CYCD2 |
| 1950 | HJACG02 | Cancer | Highly preferred indications include neoplastic diseases (e.g. cancer) such as described herein under the heading "Hyperproliferative Disordersî (particularly including, but not limited to cancers involving cells of the skin). Highly preferred embodiments of the invention include methods of preventing, detecting, diagnosing, treating and/or ameliorating cancer and hyperproliferative disorders involving skin cells. (NHDF cells are normal human dermal fibroblasts). | NHDF | Cyclin A1 | gb|U97680|HS U97680 |
| 1950 | HJACG02 | Diabetes | A highly preferred indication is diabetes. Additional highly preferred indications include complications associated with diabetes (e.g., diabetic retinopathy, diabetic nephropathy, kidney disease (e.g., renal failure, nephropathy and/or other diseases and disorders as described in the "Renal Disorders" section below), diabetic neuropathy, nerve disease and nerve damage (e.g., due to diabetic neuropathy), blood vessel blockage, heart disease, stroke, impotence (e.g., due to diabetic neuropathy or blood vessel blockage), seizures, mental confusion, drowsiness, nonketotic hyperglycemic-hyperosmolar coma, cardiovascular disease (e.g., heart disease, atherosclerosis, microvascular disease, hypertension, stroke, and other diseases and disorders as described in the "Cardiovascular Disorders" section below), dyslipidemia, endocrine disorders (as described in the "Endocrine Disorders" section below), neuropathy, vision impairment (e.g., diabetic retinopathy and blindness), ulcers and impaired wound healing, and infection (e.g., infectious diseases and disorders as described in the "Infectious Diseases" section below, especially of the urinary tract and skin). Highly preferred indications also include obesity, weight gain, and weight loss, as well as complications associated with obesity, weight gain, and weight loss. Preferred embodiments of the invention include methods of preventing, detecting, diagnosing, treating and/or | Adipocytes (4D)-09/01/01 | CAP PEPCK1 | gb|AF136380| AF136380 gb|L05144|HU MPHOCAR |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | ameliorating the above mentioned conditions, disorders, and diseases. | | | |
| 1950 | HJACG02 | Diabetes | A highly preferred indication is diabetes. Additional highly preferred indications include complications associated with diabetes (e.g., diabetic retinopathy, diabetic nephropathy, kidney disease (e.g., renal failure, nephropathy and/or other diseases and disorders as described in the "Renal Disorders" section below), diabetic neuropathy, nerve disease and nerve damage (e.g., due to diabetic neuropathy), blood vessel blockage, heart disease, stroke, impotence (e.g., due to diabetic neuropathy or blood vessel blockage), seizures, mental confusion, drowsiness, nonketotic hyperglycemic-hyperosmolar coma, cardiovascular disease (e.g., heart disease, atherosclerosis, microvascular disease, hypertension, stroke, and other diseases and disorders as described in the "Cardiovascular Disorders" section below), dyslipidemia, endocrine disorders (as described in the "Endocrine Disorders" section below), neuropathy, vision impairment (e.g., diabetic retinopathy and blindness), ulcers and impaired wound healing, and infection (e.g., infectious diseases and disorders as described in the "Infectious Diseases" section below, especially of the urinary tract and skin). Highly preferred indications also include obesity, weight gain, and weight loss, as well as complications associated with obesity, weight gain, and weight loss. Preferred embodiments of the invention include methods of preventing, detecting, diagnosing, treating and/or ameliorating the above mentioned conditions, disorders, and diseases. | Adipocytes-3/12/01 | CAP Hexokinase II | gb\|AF136380\| AF136380 gb\|Z46354\|HS HKEX1 |
| 1950 | HJACG02 | Diabetes | A highly preferred indication is diabetes. Additional highly preferred indications include complications associated with diabetes (e.g., diabetic retinopathy, diabetic nephropathy, kidney disease (e.g., renal failure, nephropathy and/or other diseases and disorders as described in the "Renal Disorders" section below), diabetic neuropathy, nerve disease and nerve damage (e.g., due to diabetic neuropathy), blood vessel blockage, heart disease, stroke, impotence (e.g., due to diabetic neuropathy or blood vessel blockage), seizures, mental confusion, drowsiness, nonketotic hyperglycemic-hyperosmolar coma, cardiovascular disease (e.g., heart disease, atherosclerosis, microvascular disease, hypertension, stroke, and other diseases and disorders as described in the "Cardiovascular Disorders" section below), dyslipidemia, endocrine disorders (as described in the "Endocrine Disorders" section below), neuropathy, vision impairment (e.g., diabetic retinopathy and blindness), ulcers and impaired wound healing, and infection (e.g., infectious diseases and disorders as described in the "Infectious Diseases" section below, especially of the urinary tract and skin). Highly preferred indications also include obesity, weight gain, and weight loss, as well as complications associated with obesity, weight gain, and weight loss. Preferred embodiments of the invention include methods of preventing, detecting, diagnosing, treating and/or ameliorating the above mentioned conditions, disorders, and diseases. (AOSMC cells are human aortic smooth muscle cells). | AOSMC | IRS1 PPARg | gb\|X90563\|HS PPARGAM |
| 1950 | HJACG02 | Diabetes | A highly preferred indication is diabetes. Additional highly preferred indications include complications associated with diabetes (e.g., | Liver | Glucose6 phosphatase | gb\|U91844\|CF U91844 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | diabetic retinopathy, diabetic nephropathy, kidney disease (e.g., renal failure, nephropathy and/or other diseases and disorders as described in the "Renal Disorders" section below), diabetic neuropathy, nerve disease and nerve damage (e.g., due to diabetic neuropathy), blood vessel blockage, heart disease, stroke, impotence (e.g., due to diabetic neuropathy or blood vessel blockage), seizures, mental confusion, drowsiness, nonketotic hyperglycemic-hyperosmolar coma, cardiovascular disease (e.g., heart disease, atherosclerosis, microvascular disease, hypertension, stroke, and other diseases and disorders as described in the "Cardiovascular Disorders" section below), dyslipidemia, endocrine disorders (as described in the "Endocrine Disorders" section below), neuropathy, vision impairment (e.g., diabetic retinopathy and blindness), ulcers and impair wound healing, and infection (e.g., infectious diseases and disorders as described in the "Infectious Diseases" section below, especially of the urinary tract and skin). Highly preferred indications also include obesity, weight gain, and weight loss, as well as complications associated with obesity, weight gain, and weight loss. Preferred embodiments of the invention include methods of preventing, detecting, diagnosing, treating and/or ameliorating the above mentioned conditions, disorders, and diseases. | | | |
| 1950 | HJACG02 | Immune | Highly preferred indications include immunological disorders such as described herein under the heading "Immune Activity" and/or "Blood-Related Disorders" (particularly including, but not limited to, immune disorders involving adipocytes). Highly preferred embodiments of the invention include methods of preventing, detecting, diagnosing, treating and/or ameliorating disorders of the immune system (particularly including, but not limited to, immune disorders involving adipocytes). | Adipocytes-3/12/01 | ICAM Il6 Rag1 | gb\|X06990\|HS ICAM1 gb\|X04403\|HS 26KDAR gb\|M29474\|H UMRAG1 |
| 1950 | HJACG02 | Immune | Highly preferred indications include immunological disorders such as described herein under the heading "Immune Activity" and/or "Blood-Related Disorders" (particularly including, but not limited to, immune disorders involving muscle tissues and the cardiovascular system (e.g. heart, lungs, circulatory system)). Highly preferred embodiments of the invention include methods of preventing, detecting, diagnosing, treating and/or ameliorating disorders of the immune system (particularly including, but not limited to, immune disorders involving muscle tissue or the cardiovascular system). (AOSMC cells are human aortic smooth muscle cells). | AOSMC | CD30 CD40 IL1B IL5 TNF VCAM | gb\|AJ300189\| HSA30018 gb\|X02532\|HS IL1BR gb\|X12705\|HS BCDFIA gb\|AJ270944\| HSA27094 gb\|A30922\|A30922 |
| 1950 | HJACG02 | Immune | Highly preferred indications include immunological disorders such as described herein under the heading "Immune Activity" and/or "Blood-Related Disorders" (particularly including, but not limited to, immune disorders involving the cells of the gastrointestinal tract). Highly preferred embodiments of the invention include methods of preventing, detecting, diagnosing, treating and/or ameliorating disorders of the immune system (particularly including, but not limited to, immune disorders involving cells of the gastrointestinal tract). (The Caco-2 cell line is a human colorectal adenocarcinoma cell line available through the ATCC ™ as cell line number HTB-37). | Caco-2 | Rag1 | gb\|M29474\|H UMRAG1 |
| 1950 | HJACG02 | Immune | Highly preferred indications include immunological disorders such as described herein under the heading "Immune Activity" | Daudi | ICAM Rag1 VCAM | gb\|X06990\|HS ICAM1 gb\|M29474\|H |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | and/or "Blood-Related Disorders" (particularly including, but not limited to, immune disorders involving the B-cells). Highly preferred embodiments of the invention include methods of preventing, detecting, diagnosing, treating and/or ameliorating disorders of the immune system (particularly including, but not limited to, immune disorders involving B-cells). (The Daudi cell line is a human B lymphoblast cell line available through the ATCC ™ as cell line number CCL-213). | | | UMRAG1 gb\|A30922\|A30922 |
| 1950 | HJACG02 | Immune | Highly preferred indications include immunological disorders such as described herein under the heading "Immune Activity" and/or "Blood-Related Disorders" (particularly including, but not limited to, immune disorders involving epithelial cells or the renal system). Highly preferred embodiments of the invention include methods of preventing, detecting, diagnosing, treating and/or ameliorating disorders of the immune system (particularly including, but not limited to, immune disorders involving epithelial cells or the renal systems). (The 293 cell line is a human embryonal kidney epithelial cell line available through the ATCC ™ as cell line number CRL-1573). | HEK293 | c-maf | gb\|AF055377\| AF055377 |
| 1950 | HJACG02 | Immune | Highly preferred indications include immunological disorders such as described herein under the heading "Immune Activity" and/or "Blood-Related Disorders" (particularly including, but not limited to, immune disorders involving endothelial cells). Highly preferred embodiments of the invention include methods of preventing, detecting, diagnosing, treating and/or ameliorating disorders of the immune system (particularly including, but not limited to, immune disorders involving endothelial cells). (HUVEC cells are human umbilical vein endothelial cells). | HUVEC | ICAM | gb\|X06990\|HS ICAM1 |
| 1950 | HJACG02 | Immune | Highly preferred indications include immunological disorders such as described herein under the heading "Immune Activity" and/or "Blood-Related Disorders" (particularly including, but not limited to, immune disorders involving T-cells). Highly preferred embodiments of the invention include methods of preventing, detecting, diagnosing, treating and/or ameliorating disorders of the immune system (particularly including, but not limited to, immune disorders involving T-cells). (The Jurkat cell line is a human T lymphocyte cell line available through the ATCC ™ as cell line number TIB-152). | Jurkat | Rag2 TNF | gb\|AY011962\| AY011962 gb\|AJ270944\| HSA27094 |
| 1950 | HJACG02 | Immune | Highly preferred indications include immunological disorders such as described herein under the heading "Immune Activity" and/or "Blood-Related Disorders" (particularly including, but not limited to, immune disorders involving the skin). Highly preferred embodiments of the invention include methods of preventing, detecting, diagnosing, treating and/or ameliorating disorders of the immune system (particularly including, but not limited to, immune disorders involving the skin). (NHDF cells are normal human dermal fibroblasts). | NHDF | Rag1 | gb\|M29474\|H UMRAG1 |
| 1950 | HJACG02 | Immune | Highly preferred indications include immunological disorders such as described herein under the heading "Immune Activity" and/or "Blood-Related Disorders" (particularly including, but not limited to, immune disorders involving monocytes). Highly preferred embodiments of the invention include methods of preventing, detecting, diagnosing, treating and/or ameliorating disorders of the immune system (particularly including, but not limited | U937 | GATA1 IL5 TNF | gb\|X17254\|HS ERYF1 gb\|X12705\|HS BCDFIA gb\|AJ270944\| HSA27094 |

TABLE 1F-continued

| Gene No. | cDNA Clone ID | Disease Class | Preferred Indications: | Cell Line | Exemplary Targets | Exemplary Accessions |
|---|---|---|---|---|---|---|
| | | | to, immune disorders involving monocytes). (The U937 cell line is a human monocyte cell line available through the ATCC ™ as cell line number CRL-1593.2). | | | |
| 2056 | HL2AC08 | Cancer | Highly preferred indications include neoplastic diseases (e.g. cancer) such as described herein under the heading "Hyperproliferative Disordersî (particularly including, but not limited to cancers involving erythrocytes). Highly preferred embodiments of the invention include methods of preventing, detecting, diagnosing, treating and/or ameliorating cancer and hyperproliferative disorders involving erythrocytes. (The TF-1 cell line is a human erythroblast cell line available through the ATCC ™ as cell line number CRL-2003). | TF-1 | p21 | gb\|BC000275\| BC000275 |
| 2056 | HL2AC08 | Immune | Highly preferred indications include immunological disorders such as described herein under the heading "Immune Activity" and/or "Blood-Related Disorders" (particularly including, but not limited to, immune disorders involving erythrocytes). Highly preferred embodiments of the invention include methods of preventing, detecting, diagnosing, treating and/or ameliorating disorders of the immune system (particularly including, but not limited to, immune disorders involving erythrocytes). (The TF-1 cell line is a human erythroblast cell line available through the ATCC ™ as cell line number CRL-2003). | TF-1 | CD69 GATA1 TNF | gb\|Z22576\|HS CD69GNA gb\|X17254\|HS ERYF1 gb\|AJ270944\| HSA27094 |

Table 2 further characterizes certain encoded polypeptides of the invention, by providing the results of comparisons to protein and protein family databases. The first column provides a unique clone identifier, "Clone ID NO:", corresponding to a cDNA clone disclosed in Table 1A and/or Table 1B. The second column provides the unique contig identifier, "Contig ID:" which allows correlation with the information in Table 1B. The third column provides the sequence identifier, "SEQ ID NO:", for the contig polynucleotide sequences. The fourth column provides the analysis method by which the homology/identity disclosed in the Table was determined. The fifth column provides a description of the PFAM/NR hit identified by each analysis. Column six provides the accession number of the PFAM/NR hit disclosed in the fifth column. Column seven, score/percent identity, provides a quality score or the percent identity, of the hit disclosed in column five, Comparisons were made between polypeptides encoded by polynucleotides of the invention and a non-redundant protein database (herein referred to as "NR"), or a database of protein families (herein referred to as "PFAM"), as described below.

The NR database, which comprises the NBRF PIR database, the NCBI GenPept database, and the SIB SwissProt and TrEMBL databases, was made non-redundant using the computer program nrdb2 (Warren Gish, Washington University in Saint Louis). Each of the polynucleotides shown in Table 1B, column 3 (e.g., SEQ ID NO:X or the 'Query' sequence) was used to search against the NR database. The computer program BLASTX was used to compare a 6-frame translation of the Query sequence to the NR database (for information about the BLASTX algorithm please see Altshul et al., J. Mol. Biol. 215:403-410 (1990), and Gish and States, Nat. Genet. 3:266-272 (1993). A description of the sequence that is most similar to the Query sequence (the highest scoring 'Subject') is shown in column five of Table 2 and the database accession number for that sequence is provided in column six. The highest scoring 'Subject' is reported in Table 2 if (a) the estimated probability that the match occurred by chance alone is less than 1.0e-07, and (b) the match was not to a known repetitive element. BLASTX returns alignments of short polypeptide segments of the Query and Subject sequences which share a high degree of similarity; these segments are known as High-Scoring Segment Pairs or HSPs. Table 2 reports the degree of similarity between the Query and the Subject for each HSP as a percent identity in Column 7. The percent identity is determined by dividing the number of exact matches between the two aligned sequences in the HSP, dividing by the number of Query amino acids in the HSP and multiplying by 100. The polynucleotides of SEQ ID NO:X which encode the polypeptide sequence that generates an HSP are delineated by columns 8 and 9 of Table 2.

The PFAM database, PFAM version 2.1, (Sonnhammer, Nucl. Acids Res., 26:320-322, 1998)) consists of a series of multiple sequence alignments; one alignment for each protein family. Each multiple sequence alignment is converted into a probability model called a Hidden Markov Model, or HMM, that represents the position-specific variation among the sequences that make up the multiple sequence alignment (see, e.g., Durbin, et al., *Biological sequence analysis: probabilistic models of proteins and nucleic acids*, Cambridge University Press, 1998 for the theory of HMMs). The program HMMER version 1.8 (Sean Eddy, Washington University in Saint Louis) was used to compare the predicted protein sequence for each Query sequence (SEQ ID NO:Y in Table 1B.1) to each of the HMMs derived from PFAM version 2.1. A HMM derived from PFAM version 2.1 was said to be a significant match to a polypeptide of the invention if the score returned by HMMER 1.8 was greater than 0.8 times the HMMER 1.8 score obtained with the most distantly related known member of that protein family. The description of the PFAM family which shares a significant match with a polypeptide of the invention is listed in column 5 of Table 2, and the database accession number of the PFAM hit is provided in column 6. Column 7 provides the score returned by HMMER version 1.8 for the alignment. Columns 8 and 9 delineate the polynucleotides of SEQ ID NO:X which encode the polypeptide sequence which show a significant match to a PFAM protein family.

As mentioned, columns 8 and 9 in Table 2, "NT From" and "NT To", delineate the polynucleotides of "SEQ ID NO:X" that encode a polypeptide having a significant match to the PFAM/NR database as disclosed in the fifth column. In one embodiment, the invention provides a protein comprising, or alternatively consisting of, a polypeptide encoded by the polynucleotides of SEQ ID NO:X delineated in columns 8 and 9 of Table 2. Also provided are polynucleotides encoding such proteins, and the complementary strand thereto.

The nucleotide sequence SEQ ID NO:X and the translated SEQ ID NO:Y are sufficiently accurate and otherwise suitable for a variety of uses well known in the art and described further below. For instance, the nucleotide sequences of SEQ ID NO:X are useful for designing nucleic acid hybridization probes that will detect nucleic acid sequences contained in SEQ ID NO:X or the cDNA contained in ATCC Deposit No:Z. These probes will also hybridize to nucleic acid molecules in biological samples, thereby enabling immediate applications in chromosome mapping, linkage analysis, tissue identification and/or typing, and a variety of forensic and diagnostic methods of the invention. Similarly, polypeptides identified from SEQ ID NO:Y may be used to generate antibodies which bind specifically to these polypeptides, or fragments thereof, and/or to the polypeptides encoded by the cDNA clones identified in, for example, Table 1A and/or 1B.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequence identified as SEQ ID NO:X, and a predicted translated amino acid sequence identified as SEQ ID NO:Y, but also a sample of plasmid DNA containing cDNA ATCC Deposit No:Z (e.g., as set forth in columns 2 and 3 of Table 1A and/or as set forth, for example, in Table 1B, 6, and 7). The nucleotide sequence of each deposited clone can readily be determined by sequencing the deposited clone in accordance with known methods. Further, techniques known in the art can be used to verify the nucleotide sequences of SEQ ID NO:X.

The predicted amino acid sequence can then be verified from such deposits. Moreover, the amino acid sequence of the protein encoded by a particular clone can also be directly determined by peptide sequencing or by expressing the protein in a suitable host cell containing the deposited human cDNA, collecting the protein, and determining its sequence.

Lengthy table referenced here

US07411051-20080812-T00005

Please refer to the end of the specification for access instructions.

RACE Protocol For Recovery of Full-Length Genes

Partial cDNA clones can be made full-length by utilizing the rapid amplification of cDNA ends (RACE) procedure described in Frohman, M. A., et al., Proc. Nat'l. Acad. Sci. USA, 85:8998-9002 (1988). A cDNA clone missing either the 5' or 3' end can be reconstructed to include the absent base pairs extending to the translational start or stop codon, respectively. In some cases, cDNAs are missing the start codon of translation, therefor. The following briefly describes a modification of this original 5' RACE procedure. Poly A+ or total RNA is reverse transcribed with Superscript II (Gibco/BRL) and an antisense or complementary primer specific to the cDNA sequence. The primer is removed from the reaction with a Microcon Concentrator (Amicon). The first-strand cDNA is then tailed with dATP and terminal deoxynucleotide transferase (Gibco/BRL). Thus, an anchor sequence is produced which is needed for PCR amplification. The second strand is synthesized from the dA-tail in PCR buffer, Taq DNA polymerase (Perkin-Elmer Cetus), an oligo-dT primer containing three adjacent restriction sites (XhoI, SalI and ClaI) at the 5' end and a primer containing just these restriction sites. This double-stranded cDNA is PCR amplified for 40 cycles with the same primers as well as a nested cDNA-specific antisense primer. The PCR products are size-separated on an ethidium bromide-agarose gel and the region of gel containing cDNA products the predicted size of missing protein-coding DNA is removed. cDNA is purified from the agarose with the Magic PCR Prep kit (Promega), restriction digested with XhoI or SalI, and ligated to a plasmid such as pBluescript SKII (Stratagene) at XhoI and EcoRV sites. This DNA is transformed into bacteria and the plasmid clones sequenced to identify the correct protein-coding inserts. Correct 5' ends are confined by comparing this sequence with the putatively identified homologue and overlap with the partial cDNA clone. Similar methods known in the art and/or commercial kits are used to amplify and recover 3' ends.

Several quality-controlled kits are commercially available for purchase. Similar reagents and methods to those above are supplied in kit form from Gibco/BRL for both 5' and 3' RACE for recovery of full length genes. A second kit is available from CLONTECH™ which is a modification of a related technique, SLIC (single-stranded ligation to single-stranded cDNA), developed by Dumas et al., Nucleic Acids Res., 19:5227-32 (1991). The major differences in procedure are that the RNA is alkaline hydrolyzed after reverse transcription and RNA ligase is used to join a restriction site-containing anchor primer to the first-strand cDNA. This obviates the necessity for the dA-tailing reaction which results in a polyT stretch that is difficult to sequence past.

An alternative to generating 5' or 3' cDNA from RNA is to use cDNA library double-stranded DNA. An asymmetric PCR-amplified antisense cDNA strand is synthesized with an antisense cDNA-specific primer and a plasmid-anchored primer. These primers are removed and a symmetric PCR reaction is performed with a nested cDNA-specific antisense primer and the plasmid-anchored primer.

RNA Ligase Protocol for Generating the 5' or 3' End Sequences to Obtain Full Length Genes Once a gene of interest is identified, several methods are available for the identification of the 5' or 3' portions of the gene which may not be present in the original cDNA plasmid. These methods include, but are not limited to, filter probing, clone enrichment using specific probes and protocols similar and identical to 5' and 3' RACE. While the full length gene may be present in the library and can be identified by probing, a useful method for generating the 5' or 3' end is to use the existing sequence information from the original cDNA to generate the missing information. A method similar to 5' RACE is available for generating the missing 5' end of a desired full-length gene. (This method was published by Fromont-Racine et al., Nucleic Acids Res., 21(7):1683-1684 (1993)). Briefly, a specific RNA oligonucleotide is ligated to the 5' ends of a population of RNA presumably containing full-length gene RNA transcript and a primer set containing a primer specific to the ligated RNA oligonucleotide and a primer specific to a known sequence of the gene of interest, is used to PCR amplify the 5' portion of the desired full length gene which may then be sequenced and used to generate the full length gene. This method starts with total RNA isolated from the desired source, poly A RNA may be used but is not a prerequisite for this procedure. The RNA preparation may then be treated with phosphatase if necessary to eliminate 5' phosphate groups on degraded or damaged RNA which may interfere with the later RNA ligase step. The phosphatase if used is then inactivated and the RNA is treated with tobacco acid pyrophosphatase in order to remove the cap structure present at the 5' ends of messenger RNAs. This reaction leaves a 5' phosphate group at the 5' end of the cap cleaved RNA which can then be ligated to an RNA oligonucleotide using T4 RNA ligase. This modified RNA preparation can then be used as a template for first strand cDNA synthesis using a gene specific oligonucleotide. The first strand synthesis reaction can then be used as a template for PCR amplification of the desired 5' end using a primer specific to the ligated RNA oligonucleotide and a primer specific to the known sequence of the gene of interest. The resultant product is then sequenced and analyzed to confirm that the 5' end sequence belongs to the relevant gene.

The present invention also relates to vectors or plasmids which include such DNA sequences, as well as the use of the DNA sequences. The material deposited with the ATCC™ (e.g., as described in columns 2 and 3 of Table 1A, and/or as set forth in Table 1B, Table 6, or Table 7) is a mixture of cDNA clones derived from a variety of human tissue and cloned in either a plasmid vector or a phage vector, as described, for example, in Table 1A and Table 7. These deposits are referred to as "the deposits" herein. The tissues from which some of the clones were derived are listed in Table 7, and the vector in which the corresponding cDNA is contained is also indicated in Table 7. The deposited material includes cDNA clones corresponding to SEQ ID NO:X described, for example, in Table 1A and/or 1B (ATCC™ Deposit No:Z). A clone which is isolatable from the ATCC™ Deposits by use of a sequence listed as SEQ ID NO:X, may include the entire coding region of a human gene or in other cases such clone may include a substantial portion of the coding region of a human gene. Furthermore, although the sequence listing may in some instances list only a portion of the DNA sequence in a clone included in the ATCC™ Deposits, it is well within the ability of one skilled in the art to sequence the DNA included in a clone contained in the ATCC™ Deposits by use of a sequence (or portion thereof) described in, for example Tables 1A and/or 1B or 2, by procedures hereinafter further described, and others apparent to those skilled in the art.

Also provided in Table 1A and 7 is the name of the vector which contains the cDNA clone. Each vector is routinely used in the art. The following additional information is provided for convenience.

Vectors Lambda Zap (U.S. Pat. Nos. 5,128,256 and 5,286,636), Uni-Zap XR (U.S. Pat. Nos. 5,128,256 and 5,286,636), Zap Express (U.S. Pat. Nos. 5,128,256 and 5,286,636), pBluescript (pBS) (Short, J. M. et al., *Nucleic Acids Res.* 16:7583-7600 (1988); Alting-Mees, M. A. and Short, J. M., *Nucleic Acids Res.* 17:9494 (1989)) and pBK (Alting-Mees, M. A. et al., *Strategies* 5:58-61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Phagemid pBS may be excised from the Lambda Zap and Uni-Zap XR vectors, and phagemid pBK may be excised from the Zap Express vector. Both phagemids may be transformed into *E. coli* strain XL-1 Blue, also available from Stratagene.

Vectors pSport1, pCMVSport 1.0, pCMVSport 2.0 and pCMVSport 3.0, were, obtained from Life Technologies, Inc., P.O. Box 6009, Gaithersburg, Md. 20897. All Sport vectors contain an ampicillin resistance gene and may be transformed into *E. coli* strain DH10B, also available from Life Technologies. See, for instance, Gruber, C. E., et al., *Focus* 15:59- (1993). Vector lafmid BA (Bento Soares, Columbia University, New York, N.Y.) contains an ampicillin resistance gene and can be transformed into *E. coli* strain XL-1 Blue. Vector pCR®2.1, which is available from Invitrogen, 1600 Faraday Avenue, Carlsbad, Calif. 92008, contains an ampicillin resistance gene and may be transformed into *E coli* strain DH10B, available from Life Technologies. See, for instance, Clark, J. M., *Nuc. Acids Res.* 16:9677-9686 (1988) and Mead, D. et al., *Bio/Technology* 9: (1991).

The present invention also relates to the genes corresponding to SEQ ID NO:X, SEQ ID NO:Y, and/or the deposited clone (ATCC™ Deposit No:Z). The corresponding gene can be isolated in accordance with known methods using the sequence information disclosed herein. Such methods include preparing probes or primers from the disclosed sequence and identifying or amplifying the corresponding gene from appropriate sources of genomic material.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to SEQ ID NO:X or the complement thereof, polypeptides encoded by genes corresponding to SEQ ID NO:X or the complement thereof, and/or the cDNA contained in ATCC™ Deposit No:Z, using information from the sequences disclosed herein or the clones deposited with the ATCC™. For example, allelic variants and/or species homologs may be isolated and identified by making suitable probes or primers from the sequences provided herein and screening a suitable nucleic acid source for allelic variants and/or the desired homologue.

The polypeptides of the invention can be prepared in any suitable manner. Such polypeptides include isolated naturally occurring polypeptides, recombinantly produced polypeptides, synthetically produced polypeptides, or polypeptides produced by a combination of these methods. Means for preparing such polypeptides are well understood in the art.

The polypeptides may be in the form of the secreted protein, including the mature form, or may be a part of a larger protein, such as a fusion protein (see below). It is often advantageous to include an additional amino acid sequence which contains secretory or leader sequences, pro-sequences, sequences which aid in purification, such as multiple histidine residues, or an additional sequence for stability during recombinant production.

The polypeptides of the present invention are preferably provided in an isolated form, and preferably are substantially purified. A recombinantly produced version of a polypeptide, including the secreted polypeptide, can be substantially purified using techniques described herein or otherwise known in the art, such as, for example, by the one-step method described in Smith and Johnson, Gene 67:31-40 (1988). Polypeptides of the invention also can be purified from natural, synthetic or recombinant sources using techniques described herein or otherwise known in the art, such as, for example, antibodies of the invention raised against the polypeptides of the present invention in methods which are well known in the art.

The present invention provides a polynucleotide comprising, or alternatively consisting of, the nucleic acid sequence of SEQ ID NO:X, and/or the cDNA sequence contained in ATCC™ Deposit No:Z. The present invention also provides a polypeptide comprising, or alternatively, consisting of, the polypeptide sequence of SEQ ID NO:Y, a polypeptide encoded by SEQ ID NO:X or a complement thereof, a polypeptide encoded by the cDNA contained in ATCC™ Deposit No:Z, and/or the polypeptide sequence encoded by a nucleotide sequence in SEQ ID NO:B as defined in column 6 of Table 1C. Polynucleotides encoding a polypeptide comprising, or alternatively consisting of the polypeptide sequence of SEQ ID NO:Y, a polypeptide encoded by SEQ ID NO:X, a polypeptide encoded by the cDNA contained in ATCC™ Deposit No:Z, and/or a polypeptide sequence encoded by a nucleotide sequence in SEQ ID NO:B as defined in column 6 of Table 1C are also encompassed by the invention. The present invention further encompasses a polynucleotide comprising, or alternatively consisting of, the complement of the nucleic acid sequence of SEQ ID NO:X, a nucleic acid sequence encoding a polypeptide encoded by the complement of the nucleic acid sequence of SEQ ID NO:X, and/or the cDNA contained in ATCC™ Deposit No:Z.

Moreover, representative examples of polynucleotides of the invention comprise, or alternatively consist of, one, two, three, four, five, six, seven, eight, nine, ten, or more of the sequences delineated in Table 1C column 6, or any combination thereof. Additional, representative examples of polynucleotides of the invention comprise, or alternatively consist of, one, two, three, four, five, six, seven, eight, nine, ten, or more of the complementary strand(s) of the sequences delineated in Table 1C column 6, or any combination thereof. In further embodiments, the above-described polynucleotides of the invention comprise, or alternatively consist of, sequences delineated in Table 1C, column 6, and have a nucleic acid sequence which is different from that of the BAC fragment having the sequence disclosed in SEQ ID NO:B (see Table 1C, column 5). In additional embodiments, the above-described polynucleotides of the invention comprise, or alternatively consist of, sequences delineated in Table 1C, column 6, and have a nucleic acid sequence which is different from that published for the BAC clone identified as BAC ID NO:A (see Table 1C, column 4). In additional embodiments, the above-described polynucleotides of the invention comprise, or alternatively consist of, sequences delineated in Table 1C, column 6, and have a nucleic acid sequence which is different from that contained in the BAC clone identified as BAC ID NO:A (see Table 1C, column 4). Polypeptides encoded by these polynucleotides, other polynucleotides that encode these polypeptides, and antibodies that bind these polypeptides are also encompassed by the invention. Additionally, fragments and variants of the above-described polynucleotides and polypeptides are also encompassed by the invention.

Further, representative examples of polynucleotides of the invention comprise, or alternatively consist of, one, two, three, four, five, six, seven, eight, nine, ten, or more of the sequences delineated in column 6 of Table 1C which correspond to the same Clone ID (see Table 1C, column 1), or any combination thereof. Additional, representative examples of polynucleotides of the invention comprise, or alternatively consist of, one, two, three, four, five, six, seven, eight, nine, ten, or more of the complementary strand(s) of the sequences delineated in column 6 of Table 1C which correspond to the same Clone ID (see Table 1C, column 1), or any combination thereof. In further embodiments, the above-described polynucleotides of the invention comprise, or alternatively consist of, sequences delineated in column 6 of Table 1C which correspond to the same Clone ID (see Table 1C, column 1) and have a nucleic acid, sequence which is different from that of the BAC fragment having the sequence disclosed in SEQ ID NO:B (see Table 1C, column 5). In additional embodiments, the above-described polynucleotides of the invention comprise, or alternatively consist of, sequences delineated in column 6 of Table 1C which correspond to the same Clone ID (see Table 1C, column 1) and have a nucleic acid sequence which is different from that published for the BAC clone identified as BAC ID NO:A (see Table-1C, column 4). In additional embodiments, the above-described polynucleotides of the invention comprise, or alternatively consist of, sequences delineated in column 6 of Table 1C which correspond to the same Clone ID (see Table 1C, column 1) and have a nucleic acid sequence which is different from that contained in the BAC clone identified as BAC ID NO:A (see Table 1C, column 4). Polypeptides encoded by these polynucleotides, other polynucleotides that encode these polypeptides, and antibodies that bind these polypeptides are also encompassed by the invention. Additionally, fragments and variants of the above-described polynucleotides and polypeptides are also encompassed by the invention.

Further, representative examples of polynucleotides of the invention comprise, or alternatively consist of; one, two, three, four, five, six, seven, eight, nine, ten, or more of the sequences delineated in column 6 of Table 1C which correspond to the same contig sequence identifier SEQ ID NO:X (see Table 1C, column 2), or any combination thereof. Additional, representative examples of polynucleotides of the invention comprise, or alternatively consist of, one, two, three, four, five, six, seven, eight, nine, ten, or more of the complementary strand(s) of the sequences delineated in column 6 of Table 1C which correspond to the same contig sequence identifier SEQ ID NO:X (see Table 1C, column 2), or any combination thereof. In further embodiments, the above-described polynucleotides of the invention comprise, or alternatively consist of, sequences delineated in column 6 of Table 1C which correspond to the same contig sequence identifier SEQ ID NO:X (see Table 1C, column 2) and have a nucleic acid sequence which is different from that of the BAC fragment having the sequence disclosed in SEQ ID NO:B (see Table 1C, column 5). In additional embodiments, the above-described polynucleotides of the invention comprise, or alternatively consist of, sequences delineated in column 6 of Table 1C which correspond to the same contig sequence identifier SEQ ID NO:X (see Table 1C, column 2) and have a nucleic acid sequence which is different from that published for the BAC clone identified as BAC ID NO:A (see Table 1C, column 4). In additional embodiments, the above-described polynucleotides of the invention comprise, or alternatively consist of, sequences delineated in column 6 of Table 1C which correspond to the same contig sequence identifier SEQ ID NO:X (see Table 1C, column 2) and have a nucleic acid sequence which is different from that contained in the BAC clone identified as BAC ID NO:A (See Table 1C, column 4). Polypeptides encoded by these polynucleotides, other polynucleotides that encode these polypeptides, and antibodies that bind these polypeptides are also encompassed by the invention. Additionally, fragments and variants of the above-described polynucleotides and polypeptides are also encompassed by the invention.

Moreover, representative examples of polynucleotides of the invention comprise, or alternatively consist of, one, two, three, four, five, six, seven, eight, nine, ten, or more of the sequences delineated in the same row of Table 1C column 6, or any combination thereof. Additional, representative examples of polynucleotides of the invention comprise, or alternatively consist of, one, two, three, four, five, six, seven, eight, nine, ten, or more of the complementary strand(s) of the sequences delineated in the same row of Table 1C column 6, or any combination thereof. In preferred embodiments, the polynucleotides of the invention comprise, or alternatively consist of, one, two, three, four, five, six, seven, eight, nine, ten, or more of the complementary strand(s) of the sequences delineated in the same row of Table 1C column 6, wherein sequentially delineated sequences in the table (i.e. corresponding to those exons located closest to each other) are directly contiguous in a 5' to 3' orientation. In further embodiments, above-described polynucleotides of the invention comprise, or alternatively consist of, sequences delineated in the same row of Table 1C, column 6, and have a nucleic acid sequence which is different from that of the BAC fragment having the sequence disclosed in SEQ ID NO:B (see Table 1C, column 5). In additional embodiments, the above-described polynucleotides of the invention comprise, or alternatively consist of, sequences delineated in the same row of Table 1C, column 6, and have a nucleic acid sequence which is different from that published for the BAC clone identified as BAC ID NO:A (see Table 1C, column 4). In additional embodiments, the above-described polynucleotides of the invention comprise, or alternatively consist of, sequences delineated in the same row of Table 1C, column 6, and have a nucleic acid sequence which is different from that contained in the BAC clone identified as BAC ID NO:A (see Table 1C, column 4). Polypeptides encoded by these polynucleotides, other polynucleotides that encode these polypeptides, and antibodies that bind these polypeptides are also encompassed by the invention.

In additional specific embodiments, polynucleotides of the invention comprise, or alternatively consist of, one, two, three, four, five, six, seven, eight, nine, ten, or more of the sequences delineated in column 6 of Table 1C, and the polynucleotide sequence of SEQ ID NO:X (e.g., as defined in Table 1C, column 2) or fragments or variants thereof. Polypeptides encoded by these polynucleotides, other polynucleotides that encode these polypeptides, and antibodies that bind these polypeptides are also encompassed by the invention.

In additional specific embodiments, polynucleotides of the invention comprise, or alternatively consist of, one, two, three, four, five, six, seven, eight, nine, ten, or more of the sequences delineated in column 6 of Table 1C which correspond to the same Clone ID (see Table 1C, column 1), and the polynucleotide sequence of SEQ ID NO:X (e.g., as defined in Table 1A, 1B, or 1C) or fragments or variants thereof. In preferred embodiments, the delineated sequence(s) and polynucleotide sequence of SEQ ID NO:X correspond to the same Clone ID. Polypeptides encoded by these polynucleotides, other polynucleotides that encode these polypeptides, and antibodies that bind these polypeptides are also encompassed by the invention.

In further specific embodiments, polynucleotides of the invention comprise, or alternatively consist of, one, two, three, four, five, six, seven, eight, nine, ten, or more of the sequences delineated in the same row of column 6 of Table 1C, and the polynucleotide sequence of SEQ ID NO:X (e.g., as defined in Table 1A, 1B, or 1C) or fragments or variants thereof. In preferred embodiments, the delineated sequence(s) and polynucleotide sequence of SEQ ID NO:X correspond to the same row of column 6 of Table 1C. Polypeptides encoded by these polynucleotides, other polynucleotides that encode these polypeptides, and antibodies that bind these polypeptides are also encompassed by the invention.

In additional specific embodiments, polynucleotides of the invention comprise, or alternatively consist of a polynucleotide sequence in which the 3' 10 polynucleotides of one of the sequences delineated in column 6 of Table 1C and the 5' 10 polynucleotides of the sequence of SEQ ID NO:X are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids that encode these polypeptides, and antibodies that bind these polypeptides are also encompassed by the invention. Additionally, fragments and variants of the above-described polynucleotides, nucleic acids, and polypeptides are also encompassed by the invention.

In additional specific embodiments, polynucleotides of the invention comprise, or alternatively consist of, a polynucleotide sequence in which the 3' 10 polynucleotides of one of the sequences delineated in column 6 of Table 1C and the 5' 10 polynucleotides of a fragment or variant of the sequence of SEQ ID NO:X are directly contiguous Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In specific embodiments, polynucleotides of the invention comprise, or alternatively consist of, a polynucleotide sequence in which the 3' 10 polynucleotides of the sequence of SEQ ID NO:X and the 5' 10 polynucleotides of the sequence of one of the sequences delineated in column 6 of Table 1C are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In specific embodiments, polynucleotides of the invention comprise, or alternatively consist of, a polynucleotide sequence in which the 3' 10 polynucleotides of a fragment or variant of the sequence of SEQ ID NO:X and the 5' 10 polynucleotides of the sequence of one of the sequences delineated in column 6 of Table 1C are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides, are also encompassed by the invention.

In further specific embodiments, polynucleotides of the invention comprise, or alternatively consist of, a polynucleotide sequence in which the 3' 10 polynucleotides of one of the sequences delineated in column 6 of Table 1C and the 5' 10 polynucleotides of another sequence in column 6 are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In specific embodiments, polynucleotides of the invention comprise, or alternatively consist of, a polynucleotide sequence in which the 3' 10 polynucleotides of one of the sequences delineated in column 6 of Table 1C and the 5' 10 polynucleotides of another sequence in column 6 corresponding to the same Clone ID (see Table 1C, column 1) are directly contiguous. Nucleic acids which hybridize to the complement of these 20 lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In specific embodiments, polynucleotides of the invention comprise, or alternatively consist of, a polynucleotide sequence in which the 3' 10 polynucleotides of one sequence in column 6 corresponding to the same contig sequence identifier SEQ ID NO:X (see Table 1C, column 2) are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In specific embodiments, polynucleotides of the invention comprise, or alternatively consist of a polynucleotide sequence in which the 3' 10 polynucleotides of one of the sequences delineated in column 6 of Table 1C and the 5' 10 polynucleotides of another sequence in column 6 corresponding to the same row are directly contiguous. In preferred embodiments, the 3' 10 polynucleotides of one of the sequences delineated in column 6 of Table 1C is directly contiguous with the 5' 1.0 polynucleotides of the next sequential exon delineated in Table 1C, column 6. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

Table 3

Many polynucleotide sequences, such as EST sequences, are publicly available and accessible through sequence databases and may have been publicly available prior to conception of the present invention. Preferably, such related polynucleotides are specifically excluded from the scope of the present invention. Accordingly, for each contig sequence (SEQ ID NO:X) listed in the fifth column of Table 1A and/or the fourth column of Table 1B.1, preferably excluded are one or more polynucleotides comprising a nucleotide sequence described by the general formula of a-b, where a is any integer between 1 and the final nucleotide minus 15 of SEQ ID NO:X, b is an integer of 15 to the final nucleotide of SEQ ID NO:X, where both a and b correspond to the positions of nucleotide residues shown in SEQ ID NO:X, and where b is greater than or equal to a +14. More specifically, preferably excluded are one or more polynucleotides comprising a nucleotide sequence described by the general formula of a-b, where a and b are integers as defined in columns 4 and 5, respectively, of Table 3. In specific embodiments, the polynucleotides of the invention do not consist of at least one, two, three, four, five, ten, or more of the specific polynucleotide sequences referenced by the Genbank Accession No. as disclosed in column 6 of Table 3 (including for example, published sequence in connection with a particular BAC clone). In further embodiments, preferably excluded from the invention are the specific polynucleotide sequence(s) contained in the clones corresponding to at least one, two, three, four, five, ten, or more of the available material having the accession numbers identified in the sixth column of this Table (including for example, the actual sequence contained in an identified BAC clone). In no way is this listing meant to encompass all of the sequences which may be excluded by the general formula, it is just a representative example. All references available through these accessions are hereby incorporated by reference in their entirety.

---

Lengthy table referenced here

US07411051-20080812-T00006

Please refer to the end of the specification for access instructions.

---

Description of Table 4

Table 4 provides a key to the tissue/cell source identifier code disclosed in Table 1B.2, column 5. Column 1 of Table 4 provides the tissue/cell source identifier code disclosed in Table 1B.2, Column 5. Columns 2-5 provide a description of the tissue or cell source. Note that "Description" and "Tissue" sources (i.e. columns 2 and 3) having the prefix "a_" indicates organs, tissues, or cells derived from "adult" sources. Codes corresponding to diseased tissues are indicated in column 6 with the word "disease." The use of the word "disease" in column 6 is non-limiting. The tissue or cell source may be specific (e.g. a neoplasm), or may be disease-associated (e.g., a tissue sample from a normal portion of a diseased organ). Furthermore, tissues and/or cells lacking the "disease" designation may still be derived from sources directly or indirectly involved in a disease state or disorder, and therefore may have a further utility in that disease state or disorder. In numerous cases where the tissue/cell source is a library, column 7 identifies the vector used to generate the library.

TABLE 4

| Code | Description | Tissue | Organ | Cell Line | Disease | Vector |
|---|---|---|---|---|---|---|
| AR022 | a_Heart | a_Heart | | | | |
| AR023 | a_Liver | a_Liver | | | | |
| AR024 | a_mammary gland | a_mammary gland | | | | |
| AR025 | a_Prostate | a_Prostate | | | | |
| AR026 | a_small intestine | a_small intestine | | | | |
| AR027 | a_Stomach | a_Stomach | | | | |
| AR028 | Blood B cells | Blood B cells | | | | |
| AR029 | Blood B cells activated | Blood B cells activated | | | | |
| AR030 | Blood B cells resting | Blood B cells resting | | | | |
| AR031 | Blood T cells activated | Blood T cells activated | | | | |
| AR032 | Blood T cells resting | Blood T cells resting | | | | |
| AR033 | brain | brain | | | | |
| AR034 | breast | breast | | | | |
| AR035 | breast cancer | breast cancer | | | | |
| AR036 | Cell Line CAOV3 | Cell Line CAOV3 | | | | |
| AR037 | cell line PA-1 | cell line PA-1 | | | | |
| AR038 | cell line transformed | cell line transformed | | | | |
| AR039 | colon | colon | | | | |
| AR040 | colon (9808co65R) | colon (9808co65R) | | | | |
| AR041 | colon (9809co15) | colon (9809co15) | | | | |
| AR042 | colon cancer | colon cancer | | | | |
| AR043 | colon cancer (9808co64R) | colon cancer (9808co64R) | | | | |
| AR044 | colon cancer 9809co14 | colon cancer 9809co14 | | | | |
| AR050 | Donor II B Cells 24 hrs | Donor II B Cells 24 hrs | | | | |
| AR051 | Donor II B Cells 72 hrs | Donor II B Cells 72 hrs | | | | |
| AR052 | Donor II B-Cells 24 hrs. | Donor II B-Cells 24 hrs. | | | | |
| AR053 | Donor II B-Cells 72 hrs | Donor II B-Cells 72 hrs | | | | |
| AR054 | Donor II Resting B Cells | Donor II Resting B Cells | | | | |
| AR055 | Heart | Heart | | | | |
| AR056 | Human Lung (clonetech) | Human Lung (clonetech) | | | | |
| AR057 | Human Mammary (CLONTECH ™) | Human Mammary (CLONTECH ™) | | | | |
| AR058 | Human Thymus (clonetech) | Human Thymus (clonetech) | | | | |
| AR059 | Jurkat (unstimulated) | Jurkat (unstimulated) | | | | |
| AR060 | Kidney | Kidney | | | | |
| AR061 | Liver | Liver | | | | |
| AR062 | Liver (CLONTECH ™) | Liver (CLONTECH ™) | | | | |
| AR063 | Lymphocytes chronic lymphocytic leukemia | Lymphocytes chronic lymphocytic leukemia | | | | |
| AR064 | Lymphocytes diffuse large B cell lymphoma | Lymphocytes diffuse large B cell lymphoma | | | | |
| AR065 | Lymphocytes follicular lymphoma | Lymphocytes follicular lymphoma | | | | |
| AR066 | normal breast | normal breast | | | | |
| AR067 | Normal Ovarian (4004901) | Normal Ovarian (4004901) | | | | |
| AR068 | Normal Ovary 9508G045 | Normal Ovary 9508G045 | | | | |
| AR069 | Normal Ovary 9701G208 | Normal Ovary 9701G208 | | | | |
| AR070 | Normal Ovary 9806G005 | Normal Ovary 9806G005 | | | | |
| AR071 | Ovarian Cancer | Ovarian Cancer | | | | |
| AR072 | Ovarian Cancer (9702G001) | Ovarian Cancer (9702G001) | | | | |
| AR073 | Ovarian Cancer (9707G029) | Ovarian Cancer (9707G029) | | | | |
| AR074 | Ovarian Cancer (9804G011) | Ovarian Cancer (9804G011) | | | | |
| AR075 | Ovarian Cancer (9806G019) | Ovarian Cancer (9806G019) | | | | |
| AR076 | Ovarian Cancer (9807G017) | Ovarian Cancer (9807G017) | | | | |
| AR077 | Ovarian Cancer (9809G001) | Ovarian Cancer (9809G001) | | | | |
| AR078 | ovarian cancer 15799 | ovarian cancer 15799 | | | | |
| AR079 | Ovarian Cancer 17717AID | Ovarian Cancer 17717AID | | | | |

TABLE 4-continued

| Code | Description | Tissue | Organ | Cell Line | Disease | Vector |
|---|---|---|---|---|---|---|
| AR080 | Ovarian Cancer 4004664B1 | Ovarian Cancer 4004664B1 | | | | |
| AR081 | Ovarian Cancer 4005315A1 | Ovarian Cancer 4005315A1 | | | | |
| AR082 | ovarian cancer 94127303 | ovarian cancer 94127303 | | | | |
| AR083 | Ovarian Cancer 96069304 | Ovarian Cancer 96069304 | | | | |
| AR084 | Ovarian Cancer 9707G029 | Ovarian Cancer 9707G029 | | | | |
| AR085 | Ovarian Cancer 9807G045 | Ovarian Cancer 9807G045 | | | | |
| AR086 | ovarian cancer 9809G001 | ovarian cancer 9809G001 | | | | |
| AR087 | Ovarian Cancer 9905C032RC | Ovarian Cancer 9905C032RC | | | | |
| AR088 | Ovarian cancer 9907 C00 3rd | Ovarian cancer 9907 C00 3rd | | | | |
| AR089 | Prostate | Prostate | | | | |
| AR090 | Prostate (clonetech) | Prostate (clonetech) | | | | |
| AR091 | prostate cancer | prostate cancer | | | | |
| AR092 | prostate cancer #15176 | prostate cancer #15176 | | | | |
| AR093 | prostate cancer #15509 | prostate cancer #15509 | | | | |
| AR094 | prostate cancer #15673 | prostate cancer #15673 | | | | |
| AR095 | Small Intestine (CLONTECH ™) | Small Intestine (CLONTECH ™) | | | | |
| AR096 | Spleen | Spleen | | | | |
| AR097 | Thymus T cells activated | Thymus T cells activated | | | | |
| AR098 | Thymus T cells resting | Thymus T cells resting | | | | |
| AR099 | Tonsil | Tonsil | | | | |
| AR100 | Tonsil germinal center centroblast | Tonsil germinal center centroblast | | | | |
| AR101 | Tonsil germinal center B cell | Tonsil germinal center B cell | | | | |
| AR102 | Tonsil lymph node | Tonsil lymph node | | | | |
| AR103 | Tonsil memory B cell | Tonsil memory B cell | | | | |
| AR104 | Whole Brain | Whole Brain | | | | |
| AR105 | Xenograft ES-2 | Xenograft ES-2 | | | | |
| AR106 | Xenograft SW626 | Xenograft SW626 | | | | |
| AR119 | 001: IL-2 | 001: IL-2 | | | | |
| AR120 | 001: IL-2.1 | 001: IL-2.1 | | | | |
| AR121 | 001: IL-2_b | 001: IL-2_b | | | | |
| AR124 | 002: Monocytes untreated (1 hr) | 002: Monocytes untreated (1 hr) | | | | |
| AR125 | 002: Monocytes untreated (5 hrs) | 002: Monocytes untreated (5 hrs) | | | | |
| AR126 | 002: Control.1C | 002: Control.1C | | | | |
| AR127 | 002: IL2.1C | 002: IL2.1C | | | | |
| AR130 | 003: Placebo-treated Rat Lacrimal Gland | 003: Placebo-treated Rat Lacrimal Gland | | | | |
| AR131 | 003: Placebo-treated Rat Submandibular Gland | 003: Placebo-treated Rat Submandibular Gland | | | | |
| AR135 | 004: Monocytes untreated (5 hrs) | 004: Monocytes untreated (5 hrs) | | | | |
| AR136 | 004: Monocytes untreated 1 hr | 004: Monocytes untreated 1 hr | | | | |
| AR139 | 005: Placebo (48 hrs) | 005: Placebo (48 hrs) | | | | |
| AR140 | 006: pC4 (24 hrs) | 006: pC4 (24 hrs) | | | | |
| AR141 | 006: pC4 (48 hrs) | 006: pC4 (48 hrs) | | | | |
| AR152 | 007: PHA(1 hr) | 007: PHA(1 hr) | | | | |
| AR153 | 007: PHA(6 HRS) | 007: PHA(6 HRS) | | | | |
| AR154 | 007: PMA(6 hrs) | 007: PMA(6 hrs) | | | | |
| AR155 | 008: 1449_#2 | 008: 1449_#2 | | | | |
| AR161 | 01: A - max24 | 01: A - max24 | | | | |
| AR162 | 01: A - max26 | 01: A - max26 | | | | |
| AR163 | 01: A - max30 | 01: A - max30 | | | | |
| AR164 | 01: B - max24 | 01: B - max24 | | | | |
| AR165 | 01: B - max26 | 01: B - max26 | | | | |
| AR166 | 01: B - max30 | 01: B - max30 | | | | |
| AR167 | 1449 Sample | 1449 Sample | | | | |
| AR168 | 3T3P10 1.0 uM insulin | 3T3P10 1.0 uM insulin | | | | |
| AR169 | 3T3P10 10 nM Insulin | 3T3P10 10 nM Insulin | | | | |
| AR170 | 3T3P10 10 uM insulin | 3T3P10 10 uM insulin | | | | |
| AR171 | 3T3P10 No Insulin | 3T3P10 No Insulin | | | | |
| AR172 | 3T3P4 | 3T3P4 | | | | |
| AR173 | Adipose (41892) | Adipose (41892) | | | | |
| AR174 | Adipose Diabetic (41611) | Adipose Diabetic (41611) | | | | |

TABLE 4-continued

| Code | Description | Tissue | Organ | Cell Line | Disease | Vector |
|---|---|---|---|---|---|---|
| AR175 | Adipose Diabetic (41661) | Adipose Diabetic (41661) | | | | |
| AR176 | Adipose Diabetic (41689) | Adipose Diabetic (41689) | | | | |
| AR177 | Adipose Diabetic (41706) | Adipose Diabetic (41706) | | | | |
| AR178 | Adipose Diabetic (42352) | Adipose Diabetic (42352) | | | | |
| AR179 | Adipose Diabetic (42366) | Adipose Diabetic (42366) | | | | |
| AR180 | Adipose Diabetic (42452) | Adipose Diabetic (42452) | | | | |
| AR181 | Adipose Diabetic (42491) | Adipose Diabetic (42491) | | | | |
| AR182 | Adipose Normal (41843) | Adipose Normal (41843) | | | | |
| AR183 | Adipose Normal (41893) | Adipose Normal (41893) | | | | |
| AR184 | Adipose Normal (42452) | Adipose Normal (42452) | | | | |
| AR185 | Adrenal Gland | Adrenal Gland | | | | |
| AR186 | Adrenal Gland + Whole Brain | Adrenal Gland + Whole Brain | | | | |
| AR187 | B7(1 hr) + (inverted) | B7(1 hr) + (inverted) | | | | |
| AR188 | Breast (18275A2B) | Breast (18275A2B) | | | | |
| AR189 | Breast (4004199) | Breast (4004199) | | | | |
| AR190 | Breast (4004399) | Breast (4004399) | | | | |
| AR191 | Breast (4004943B7) | Breast (4004943B7) | | | | |
| AR192 | Breast (4005570B1) | Breast (4005570B1) | | | | |
| AR193 | Breast Cancer (4004127A30) | Breast Cancer (4004127A30) | | | | |
| AR194 | Breast Cancer (400443A21) | Breast Cancer (400443A21) | | | | |
| AR195 | Breast Cancer (4004643A2) | Breast Cancer (4004643A2) | | | | |
| AR196 | Breast Cancer (4004710A7) | Breast Cancer (4004710A7) | | | | |
| AR197 | Breast Cancer (4004943A21) | Breast Cancer (4004943A21) | | | | |
| AR198 | Breast Cancer (400553A2) | Breast Cancer (400553A2) | | | | |
| AR199 | Breast Cancer (9805C046R) | Breast Cancer (9805C046R) | | | | |
| AR200 | Breast Cancer (9806C012R) | Breast Cancer (9806C012R) | | | | |
| AR201 | Breast Cancer (ODQ 45913) | Breast Cancer (ODQ 45913) | | | | |
| AR202 | Breast Cancer (ODQ45913) | Breast Cancer (ODQ45913) | | | | |
| AR203 | Breast Cancer (ODQ4591B) | Breast Cancer (ODQ4591B) | | | | |
| AR204 | Colon Cancer (15663) | Colon Cancer (15663) | | | | |
| AR205 | Colon Cancer (4005144A4) | Colon Cancer (4005144A4) | | | | |
| AR206 | Colon Cancer (4005413A4) | Colon Cancer (4005413A4) | | | | |
| AR207 | Colon Cancer (4005570B1) | Colon Cancer (4005570B1) | | | | |
| AR208 | Control RNA #1 | Control RNA #1 | | | | |
| AR209 | Control RNA #2 | Control RNA #2 | | | | |
| AR210 | Cultured Preadipocyte (blue) | Cultured Preadipocyte (blue) | | | | |
| AR211 | Cultured Preadipocyte (Red) | Cultured Preadipocyte (Red) | | | | |
| AR212 | Donor II B-Cells 24 hrs | Donor II B-Cells 24 hrs | | | | |
| AR213 | Donor II Resting B-Cells | Donor II Resting B-Cells | | | | |
| AR214 | H114EP12 10 nM Insulin | H114EP12 10 nM Insulin | | | | |
| AR215 | H114EP12 (10 nM insulin) | H114EP12 (10 nM insulin) | | | | |
| AR216 | H114EP12 (2.6 ug/ul) | H114EP12 (2.6 ug/ul) | | | | |
| AR217 | H114EP12 (3.6 ug/ul) | H114EP12 (3.6 ug/ul) | | | | |
| AR218 | HUVEC #1 | HUVEC #1 | | | | |
| AR219 | HUVEC #2 | HUVEC #2 | | | | |
| AR221 | L6 undiff. | L6 undiff. | | | | |
| AR222 | L6 Undifferentiated | L6 Undifferentiated | | | | |
| AR223 | L6P8 30 0 10 nM Insulin | L6P8 + 10 nM Insulin | | | | |
| AR224 | L6P8 30 0 HS | L6P8 30 0 HS | | | | |
| AR225 | L6P8 10 nM Insulin | L6P8 10 nM Insulin | | | | |
| AR226 | Liver (00-06-A007B) | Liver (00-06-A007B) | | | | |
| AR227 | Liver (96-02-A075) | Liver (96-02-A075) | | | | |

TABLE 4-continued

| Code | Description | Tissue | Organ | Cell Line | Disease | Vector |
|---|---|---|---|---|---|---|
| AR228 | Liver (96-03-A144) | Liver (96-03-A144) | | | | |
| AR229 | Liver (96-04-A138) | Liver (96-04-A138) | | | | |
| AR230 | Liver (97-10-A074B) | Liver (97-10-A074B) | | | | |
| AR231 | Liver (98-09-A242A) | Liver (98-09-A242A) | | | | |
| AR232 | Liver Diabetic (1042) | Liver Diabetic (1042) | | | | |
| AR233 | Liver Diabetic (41616) | Liver Diabetic (41616) | | | | |
| AR234 | Liver Diabetic (41955) | Liver Diabetic (41955) | | | | |
| AR235 | Liver Diabetic (42352R) | Liver Diabetic (42352R) | | | | |
| AR236 | Liver Diabetic (42366) | Liver Diabetic (42366) | | | | |
| AR237 | Liver Diabetic (42483) | Liver Diabetic (42483) | | | | |
| AR238 | Liver Diabetic (42491) | Liver Diabetic (42491) | | | | |
| AR239 | Liver Diabetic (99-09-A281A) | Liver Diabetic (99-09-A281A) | | | | |
| AR240 | Lun | Lung | | | | |
| AR241 | Lung (27270) | Lung (27270) | | | | |
| AR242 | Lung (2727Q) | Lung (2727Q) | | | | |
| AR243 | Lung Cancer (4005116A1) | Lung Cancer (4005116A1) | | | | |
| AR244 | Lung Cancer (4005121A5) | Lung Cancer (4005121A5) | | | | |
| AR245 | Lung Cancer (4005121A5)) | Lung Cancer (4005121A5)) | | | | |
| AR246 | Lung Cancer (4005340A4) | Lung Cancer (4005340A4) | | | | |
| AR247 | Mammary Gland | Mammary Gland | | | | |
| AR248 | Monocyte (CT) | Monocyte (CT) | | | | |
| AR249 | Monocyte (OCT) | Monocyte (OCT) | | | | |
| AR250 | Monocytes (CT) | Monocytes (CT) | | | | |
| AR251 | Monocytes (INFG 18 hr) | Monocytes (INFG 18 hr) | | | | |
| AR252 | Monocytes (INFG 18 hr) | Monocytes (INFG 18 hr) | | | | |
| AR253 | Monocytes (INFG 8–11) | Monocytes (INFG 8–11) | | | | |
| AR254 | Monocytes (O CT) | Monocytes (O CT) | | | | |
| AR255 | Muscle (91-01-A105) | Muscle (91-01-A105) | | | | |
| AR256 | Muscle (92-04-A059) | Muscle (92-04-A059) | | | | |
| AR257 | Muscle (97-11-A056d) | Muscle (97-11-A056d) | | | | |
| AR258 | Muscle (99-06-A210A) | Muscle (99-06-A210A) | | | | |
| AR259 | Muscle (99-07-A203B) | Muscle (99-07-A203B) | | | | |
| AR260 | Muscle (99-7-A203B) | Muscle (99-7-A203B) | | | | |
| AR261 | Muscle Diabetic (42352R) | | | | | |
| AR262 | Muscle Diabetic (42366) | Muscle Diabetic (42366) | | | | |
| AR263 | NK-19 Control | NK-19 Control | | | | |
| AR264 | NK-19 IL Treated 72 hrs | NK-19 IL Treated 72 hrs | | | | |
| AR265 | NK-19 UK Treated 72 hrs. | NK-19 UK Treated 72 hrs. | | | | |
| AR266 | Omentum Normal (94-08-B009) | Omentum Normal (94-08-B009) | | | | |
| AR267 | Omentum Normal (97-01-A039A) | Omentum Normal (97-01-A039A) | | | | |
| AR268 | Omentum Normal (97-04-A114C) | Omentum Normal (97-04-A114C) | | | | |
| AR269 | Omentum Normal (97-06-A117C) | Omentum Normal (97-06-A117C) | | | | |
| AR270 | Omentum Normal (97-09-B004C) | Omentum Normal (97-09-B004C) | | | | |
| AR271 | Ovarian Cancer (17717AID) | Ovarian Cancer (17717AID) | | | | |
| AR272 | Ovarian Cancer (9905C023RC) | Ovarian Cancer (9905C023RC) | | | | |
| AR273 | Ovarian Cancer (9905C032RC) | Ovarian Cancer (9905C032RC) | | | | |
| AR274 | Ovary (9508G045) | Ovary (9508G045) | | | | |
| AR275 | Ovary (9701G208) | Ovary (9701G208) | | | | |
| AR276 | Ovary 9806G005 | Ovary 9806G005 | | | | |
| AR277 | Pancreas | Pancreas | | | | |
| AR278 | Placebo | Placebo | | | | |
| AR279 | rIL2 Control | rIL2 Control | | | | |
| AR280 | RSS288L | RSS288L | | | | |
| AR281 | RSS288LC | RSS288LC | | | | |
| AR282 | Salivary Gland | Salivary Gland | | | | |
| AR283 | Skeletal Muscle | Skeletal Muscle | | | | |
| AR284 | Skeletal Muscle (91-01-A105) | Skeletal Muscle (91-01-A105) | | | | |
| AR285 | Skeletal Muscle (42180) | Skeletal Muscle (42180) | | | | |
| AR286 | Skeletal Muscle (42386) | Skeletal Muscle (42386) | | | | |
| AR287 | Skeletal Muscle (42461) | Skeletal Muscle (42461) | | | | |

TABLE 4-continued

| Code | Description | Tissue | Organ | Cell Line | Disease | Vector |
|---|---|---|---|---|---|---|
| AR288 | Skeletal Muscle (91-01-A105) | Skeletal Muscle (91-01-A105) | | | | |
| AR289 | Skeletal Muscle (92-04-A059) | Skeletal Muscle (92-04-A059) | | | | |
| AR290 | Skeletal Muscle (96-08-A171) | Skeletal Muscle (96-08-A171) | | | | |
| AR291 | Skeletal Muscle (97-07-A190A) | Skeletal Muscle (97-07-A190A) | | | | |
| AR292 | Skeletal Muscle Diabetic (42352) | Skeletal Muscle Diabetic (42352) | | | | |
| AR293 | Skeletal Muscle Diabetic (42366) | Skeletal Muscle Diabetic (42366) | | | | |
| AR294 | Skeletal Muscle Diabetic (42395) | Skeletal Muscle Diabetic (42395) | | | | |
| AR295 | Skeletal Muscle Diabetic (42483) | Skeletal Muscle Diabetic (42483) | | | | |
| AR296 | Skeletal Muscle Diabetic (42491) | Skeletal Muscle Diabetic (42491) | | | | |
| AR297 | Skeletal Muscle Diabetic 42352 | Skeletal Muscle Diabetic 42352 | | | | |
| AR298 | Skeletal Musle (42461) | Skeletal Musle (42461) | | | | |
| AR299 | Small Intestine | Small Intestine | | | | |
| AR300 | Stomach | Stomach | | | | |
| AR301 | T-Cell + HDPBQ71.fc 1449 16 hrs | T-Cell + HDPBQ71.fc 1449 16 hrs | | | | |
| AR302 | T-Cell + HDPBQ71.fc 1449 6 hrs | T-Cell + HDPBQ71.fc 1449 6 hrs | | | | |
| AR303 | T-Cell + IL2 16 hrs | T-Cell + IL2 16 hrs | | | | |
| AR304 | T-Cell + IL2 6 hrs | T-Cell + IL2 6 hrs | | | | |
| AR306 | T-Cell Untreated 16 hrs | T-Cell Untreated 16 hrs | | | | |
| AR307 | T-Cell Untreated 6 hrs | T-Cell Untreated 6 hrs | | | | |
| AR308 | T-Cells 24 hours | T-Cells 24 hours | | | | |
| AR309 | T-Cells 24 hrs | T-Cells 24 hrs | | | | |
| AR310 | T-Cells 24 hrs. | T-Cells 24 hrs. | | | | |
| AR311 | T-Cells 24 hrs | T-Cells 24 hrs | | | | |
| AR312 | T-Cells 4 days | T-Cells 4 days | | | | |
| AR313 | Thymus | Thymus | | | | |
| AR314 | TRE | TRE | | | | |
| AR315 | TREC | TREC | | | | |
| AR317 | B lymphocyte, | B lymphocyte, | | | | |
| AR318 | (non-T; non-B) | (non-T; non-B) | | | | |
| AR326 | 001–293 RNA (Vector Control) | 001–293 RNA (Vector Control) | | | | |
| AR327 | 001: Control | 001: Control | | | | |
| AR328 | 001: Control.1 | 001: Control.1 | | | | |
| AR355 | Acute Lymphocyte Leukemia | Acute Lymphocyte Leukemia | | | | |
| AR356 | AML Patient #11 | AML Patient #11 | | | | |
| AR357 | AML Patient #2 | AML Patient #2 | | | | |
| AR358 | AML Patient #2 SGAH | AML Patient #2 SGAH | | | | |
| AR359 | AML Patient#2 | AML Patient#2 | | | | |
| AR360 | Aorta | Aorta | | | | |
| AR361 | B Cell | B Cell | | | | |
| AR362 | B lymphoblast | B lymphoblast | | | | |
| AR363 | B lymphocyte | B lymphocyte | | | | |
| AR364 | B lymphocytes | B lymphocytes | | | | |
| AR365 | B-cell | B-cell | | | | |
| AR366 | B-Cells | B-Cells | | | | |
| AR367 | B-Lymphoblast | B-Lymphoblast | | | | |
| AR368 | B-Lymphocytes | B-Lymphocytes | | | | |
| AR369 | Bladder | Bladder | | | | |
| AR370 | Bone Marrow | Bone Marrow | | | | |
| AR371 | Bronchial Epithelial Cell | Bronchial Epithelial Cell | | | | |
| AR372 | Bronchial Epithelial Cells | Bronchial Epithelial Cells | | | | |
| AR373 | Caco-2A | Caco-2A | | | | |
| AR374 | Caco-2B | Caco-2B | | | | |
| AR375 | Caco-2C | Caco-2C | | | | |
| AR376 | Cardiac #1 | Cardiac #1 | | | | |
| AR377 | Cardiac #2 | Cardiac #2 | | | | |
| AR378 | Chest Muscle | Chest Muscle | | | | |
| AR381 | Dendritic Cell | Dendritic Cell | | | | |
| AR382 | Dendritic cells | Dendritic cells | | | | |
| AR383 | *E. coli* | *E. coli* | | | | |
| AR384 | Epithelial Cells | Epithelial Cells | | | | |
| AR385 | Esophagus | Esophagus | | | | |
| AR386 | FPPS | FPPS | | | | |

TABLE 4-continued

| Code | Description | Tissue | Organ | Cell Line | Disease | Vector |
|---|---|---|---|---|---|---|
| AR387 | FPPSC | FPPSC | | | | |
| AR388 | HepG2 Cell Line | HepG2 Cell Line | | | | |
| AR389 | HepG2 Cell line Buffer 1 hr. | HepG2 Cell line Buffer 1 hr. | | | | |
| AR390 | HepG2 Cell line Buffer 06 hr | HepG2 Cell line Buffer 06 hr | | | | |
| AR391 | HepG2 Cell line Buffer 24 hr. | HepG2 Cell line Buffer 24 hr. | | | | |
| AR392 | HepG2 Cell line Insulin 01 hr. | HepG2 Cell line Insulin 01 hr. | | | | |
| AR393 | HepG2 Cell line Insulin 06 hr. | HepG2 Cell line Insulin 06 hr. | | | | |
| AR394 | HepG2 Cell line Insulin 24 hr. | HepG2 Cell line Insulin 24 hr. | | | | |
| AR398 | HMC-1 | HMC-1 | | | | |
| AR399 | HMCS | HMCS | | | | |
| AR400 | HMSC | HMSC | | | | |
| AR401 | HUVEC #3 | HUVEC #3 | | | | |
| AR402 | HUVEC #4 | HUVEC #4 | | | | |
| AR404 | KIDNEY NORMAL | KIDNEY NORMAL | | | | |
| AR405 | KIDNEY TUMOR | KIDNEY TUMOR | | | | |
| AR406 | KIDNEY TUMOR | | | | | |
| AR407 | Lymph Node | Lymph Node | | | | |
| AR408 | Macrophage | Macrophage | | | | |
| AR409 | Megakarioblast | Megakarioblast | | | | |
| AR410 | Monocyte | Monocyte | | | | |
| AR411 | Monocytes | Monocytes | | | | |
| AR412 | Myocardium | Myocardium | | | | |
| AR413 | Myocardium #3 | Myocardium #3 | | | | |
| AR414 | Myocardium #4 | Myocardium #4 | | | | |
| AR415 | Myocardium #5 | Myocardium #5 | | | | |
| AR416 | NK | NK | | | | |
| AR417 | NK cell | NK cell | | | | |
| AR418 | NK cells | NK cells | | | | |
| AR419 | NKYa | NKYa | | | | |
| AR420 | NKYa019 | NKYa019 | | | | |
| AR421 | Ovary | Ovary | | | | |
| AR422 | Patient #11 | Patient #11 | | | | |
| AR423 | Peripheral blood | Peripheral blood | | | | |
| AR424 | Primary Adipocytes | Primary Adipocytes | | | | |
| AR425 | Promyeloblast | Promyeloblast | | | | |
| AR427 | RSSWT | RSSWT | | | | |
| AR428 | RSSWTC | RSSWTC | | | | |
| AR429 | SW 480(G1) | SW 480(G1) | | | | |
| AR430 | SW 480(G2) | SW 480(G2) | | | | |
| AR431 | SW 480(G3) | SW 480(G3) | | | | |
| AR432 | SW 480(G4) | SW 480(G4) | | | | |
| AR433 | SW 480(G5) | SW 480(G5) | | | | |
| AR434 | T Lymphoblast | T Lymphoblast | | | | |
| AR435 | T Lymphocyte | T Lymphocyte | | | | |
| AR436 | T-Cell | T-Cell | | | | |
| AR438 | T-Cell, | T-Cell, | | | | |
| AR439 | T-Cells | T-Cells | | | | |
| AR440 | T-lymphoblast | T-lymphoblast | | | | |
| AR441 | Th 1 | Th 1 | | | | |
| AR442 | Th 2 | Th 2 | | | | |
| AR443 | Th1 | Th1 | | | | |
| AR444 | Th2 | Th2 | | | | |
| H0002 | Human Adult Heart | Human Adult Heart | Heart | | | Uni-ZAP XR |
| H0003 | Human Adult Liver | Human Adult Liver | Liver | | | Uni-ZAP XR |
| H0004 | Human Adult Spleen | Human Adult Spleen | Spleen | | | Uni-ZAP XR |
| H0006 | Human Frontal Lobe of Brain | | | | | Uni-ZAP XR |
| H0007 | Human Cerebellum | Human Cerebellum | Brain | | | Uni-ZAP XR |
| H0008 | Whole 6 Week Old Embryo | | | | | Uni-ZAP XR |
| H0009 | Human Fetal Brain | | | | | Uni-ZAP XR |
| H0011 | Human Fetal Kidney | Human Fetal Kidney | Kidney | | | Uni-ZAP XR |
| H0012 | Human Fetal Kidney | Human Fetal Kidney | Kidney | | | Uni-ZAP XR |
| H0013 | Human 8 Week Whole Embryo | Human 8 Week Old Embryo | Embryo | | | Uni-ZAP XR |
| H0014 | Human Gall Bladder | Human Gall Bladder | Gall Bladder | | | Uni-ZAP XR |
| H0015 | Human Gall Bladder, fraction II | Human Gall Bladder | Gall Bladder | | | Uni-ZAP XR |
| H0016 | Human Greater Omentum | Human Greater Omentum | peritoneum | | | Uni-ZAP XR |

TABLE 4-continued

| Code | Description | Tissue | Organ | Cell Line | Disease | Vector |
|---|---|---|---|---|---|---|
| H0017 | Human Greater Omentum | Human Greater Omentum | peritoneum | | | Uni-ZAP XR |
| H0018 | Human Greater Omentum, fII remake | Human Greater Omentum | peritoneum | | | Uni-ZAP XR |
| H0019 | Human Fetal Heart | Human Fetal Heart | Heart | | | pBluescript |
| H0020 | Human Hippocampus | Human Hippocampus | Brain | | | Uni-ZAP XR |
| H0021 | Human Infant Adrenal Gland | Human Infant Adrenal Gland | Adrenal gland | | | Uni-ZAP XR |
| H0022 | Jurkat Cells | Jurkat T-Cell Line | | | | Lambda ZAP II |
| H0023 | Human Fetal Lung | | | | | Uni-ZAP XR |
| H0024 | Human Fetal Lung III | Human Fetal Lung | Lung | | | Uni-ZAP XR |
| H0025 | Human Adult Lymph Node | Human Adult Lymph Node | Lymph Node | | | Lambda ZAP II |
| H0026 | Namalwa Cells | Namalwa B-Cell Line, EBV immortalized | | | | Lambda ZAP II |
| H0028 | Human Old Ovary | Human Old Ovary | Ovary | | | pBluescript |
| H0029 | Human Pancreas | Human Pancreas | Pancreas | | | Uni-ZAP XR |
| H0030 | Human Placenta | | | | | Uni-ZAP XR |
| H0031 | Human Placenta | Human Placenta | Placenta | | | Uni-ZAP XR |
| H0032 | Human Prostate | Human Prostate | Prostate | | | Uni-ZAP XR |
| H0033 | Human Pituitary | Human Pituitary | | | | Uni-ZAP XR |
| H0034 | Human Parathyroid Tumor | Human Parathyroid Tumor | Parathyroid | | disease | Uni-ZAP XR |
| H0036 | Human Adult Small Intestine | Human Adult Small Intestine | Small Int. | | | Uni-ZAP XR |
| H0037 | Human Adult Small Intestine | Human Adult Small Intestine | Small Int. | | | pBluescript |
| H0038 | Human Testes | Human Testes | Testis | | | Uni-ZAP XR |
| H0039 | Human Pancreas Tumor | Human Pancreas Tumor | Pancreas | | disease | Uni-ZAP XR |
| H0040 | Human Testes Tumor | Human Testes Tumor | Testis | | disease | Uni-ZAP XR |
| H0041 | Human Fetal Bone | Human Fetal Bone | Bone | | | Uni-ZAP XR |
| H0042 | Human Adult Pulmonary | Human Adult Pulmonary | Lung | | | Uni-ZAP XR |
| H0044 | Human Cornea | Human Cornea | eye | | | Uni-ZAP XR |
| H0045 | Human Esophagus, Cancer | Human Esophagus, cancer | Esophagus | | disease | Uni-ZAP XR |
| H0046 | Human Endometrial Tumor | Human Endometrial Tumor | Uterus | | disease | Uni-ZAP XR |
| H0047 | Human Fetal Liver | Human Fetal Liver | Liver | | | Uni-ZAP XR |
| H0048 | Human Pineal Gland | Human Pineal Gland | | | | Uni-ZAP XR |
| H0049 | Human Fetal Kidney | Human Fetal Kidney | Kidney | | | Uni-ZAP XR |
| H0050 | Human Fetal Heart | Human Fetal Heart | Heart | | | Uni-ZAP XR |
| H0051 | Human Hippocampus | Human Hippocampus | Brain | | | Uni-ZAP XR |
| H0052 | Human Cerebellum | Human Cerebellum | Brain | | | Uni-ZAP XR |
| H0053 | Human Adult Kidney | Human Adult Kidney | Kidney | | | Uni-ZAP XR |
| H0056 | Human Umbilical Vein, Endo. remake | Human Umbilical Vein Endothelial Cells | Umbilical vein | | | Uni-ZAP XR |
| H0057 | Human Fetal Spleen | | | | | Uni-ZAP XR |
| H0058 | Human Thymus Tumor | Human Thymus Tumor | Thymus | | disease | Lambda ZAP II |
| H0059 | Human Uterine Cancer | Human Uterine Cancer | Uterus | | disease | Lambda ZAP II |
| H0060 | Human Macrophage | Human Macrophage | Blood | Cell Line | | pBluescript |
| H0061 | Human Macrophage | Human Macrophage | Blood | Cell Line | | pBluescript |
| H0062 | Human Thymus | Human Thymus | Thymus | | | Uni-ZAP XR |
| H0063 | Human Thymus | Human Thymus | Thymus | | | Uni-ZAP XR |
| H0065 | Human Esophagus, Normal | Human Esophagus, normal | Esophagus | | | Uni-ZAP XR |
| H0067 | Human left hemisphere, adult | Human Left Hemisphere, Adult | Brain | | | Lambda ZAP II |
| H0068 | Human Skin Tumor | Human Skin Tumor | Skin | | disease | Uni-ZAP XR |
| H0069 | Human Activated T-Cells | Activated T-Cells | Blood | Cell Line | | Uni-ZAP XR |
| H0070 | Human Pancreas | Human Pancreas | Pancreas | | | Uni-ZAP XR |
| H0071 | Human Infant Adrenal Gland | Human Infant Adrenal Gland | Adrenal gland | | | Uni-ZAP XR |
| H0073 | Human Leiomyeloid Carcinoma | Human Leiomyeloid Carcinoma | Muscle | | disease | Uni-ZAP XR |
| H0074 | Human Platelets | Human Platelets | Blood | Cell Line | | Uni-ZAP XR |
| H0075 | Human Activated T-Cells (II) | Activated T-Cells | Blood | Cell Line | | Uni-ZAP XR |
| H0076 | Human Membrane Bound Polysomes | Human Membrane Bound Polysomes | Blood | Cell Line | | Uni-ZAP XR |
| H0077 | Human Thymus Tumor | Human Thymus Tumor | Thymus | | disease | Lambda ZAP II |
| H0078 | Human Lung Cancer | Human Lung Cancer | Lung | | disease | Lambda ZAP II |
| H0079 | Human Whole 7 Week Old Embryo (II) | Human Whole 7 Week Old Embryo | Embryo | | | Uni-ZAP XR |
| H0080 | Human Whole 6 Week Old Embryo (II) | Human Whole Six Week Old Embryo | Embryo | | | Lambda ZAP II |
| H0081 | Human Fetal Epithelium (Skin) | Human Fetal Skin | Skin | | | Uni-ZAP XR |

TABLE 4-continued

| Code | Description | Tissue | Organ | Cell Line | Disease | Vector |
|---|---|---|---|---|---|---|
| H0082 | Human Fetal Muscle | Human Fetal Muscle | Sk Muscle | | | Uni-ZAP XR |
| H0083 | HUMAN JURKAT MEMBRANE BOUND POLYSOMES | Jurkat Cells | | | | Uni-ZAP XR |
| H0085 | Human Colon | Human Colon | | | | Lambda ZAP II |
| H0086 | Human epithelioid sarcoma | Epithelioid Sarcoma, muscle | Sk Muscle | | disease | Uni-ZAP XR |
| H0087 | Human Thymus | Human Thymus | | | | pBluescript |
| H0090 | Human T-Cell Lymphoma | T-Cell Lymphoma | T-Cell | | disease | Uni-ZAP XR |
| H0092 | Human Pancreas Tumor | Human Pancreas Tumor | Pancreas | | disease | Uni-ZAP XR |
| H0095 | Human Greater Omentum, RNA Remake | Human Greater Omentum | peritoneum | | | Uni-ZAP XR |
| H0096 | Human Parotid Cancer | Human Parotid Cancer | Parotid | | disease | Lambda ZAP II |
| H0097 | Human Adult Heart, subtracted | Human Adult Heart | Heart | | | pBluescript |
| H0098 | Human Adult Liver, subtracted | Human Adult Liver | Liver | | | Uni-ZAP XR |
| H0099 | Human Lung Cancer, subtracted | Human Lung Cancer | Lung | | | pBluescript |
| H0100 | Human Whole Six Week Old Embryo | Human Whole Six Week Old Embryo | Embryo | | | Uni-ZAP XR |
| H0101 | Human 7 Weeks Old Embryo, subtracted | Human Whole 7 Week Old Embryo | Embryo | | | Lambda ZAP II |
| H0102 | Human Whole 6 Week Old Embryo (II), subt | Human Whole Six Week Old Embryo | Embryo | | | pBluescript |
| H0103 | Human Fetal Brain, subtracted | Human Fetal Brain | Brain | | | Uni-ZAP XR |
| H0105 | Human Fetal Heart, subtracted | Human Fetal Heart | Heart | | | pBluescript |
| H0106 | Human Right Hemisphere of Brain, subtrac | Human Brain, right hemisphere | Brain | | | Uni-ZAP XR |
| H0107 | Human Infant Adrenal Gland, subtracted | Human Infant Adrenal Gland | Adrenal gland | | | pBluescript |
| H0108 | Human Adult Lymph Node, subtracted | Human Adult Lymph Node | Lymph Node | | | Uni-ZAP XR |
| H0109 | Human Macrophage, subtracted | Macrophage | Blood | Cell Line | | pBluescript |
| H0110 | Human Old Ovary, subtracted | Human Old Ovary | Ovary | | | pBluescript |
| H0111 | Human Placenta, subtracted | Human Placenta | Placenta | | | pBluescript |
| H0112 | Human Parathyroid Tumor, subtracted | Human Parathyroid Tumor | Parathyroid | | | pBluescript |
| H0113 | Human skin Tumor, subtracted | Human Skin Tumor | Skin | | | Uni-ZAP XR |
| H0116 | Human Thymus Tumor, subtracted | Human Thymus Tumor | Thymus | | | pBluescript |
| H0117 | Human Uterine Cancer, subtracted | Human Uterine Cancer | Uterus | | | pBluescript |
| H0118 | Human Adult Kidney | Human Adult Kidney | Kidney | | | Uni-ZAP XR |
| H0119 | Human Pediatric Kidney | Human Pediatric Kidney | Kidney | | | Uni-ZAP XR |
| H0120 | Human Adult Spleen, subtracted | Human Adult Spleen | Spleen | | | Uni-ZAP XR |
| H0121 | Human Cornea, subtracted | Human Cornea | eye | | | Uni-ZAP XR |
| H0122 | Human Adult Skeletal Muscle | Human Skeletal Muscle | Sk Muscle | | | Uni-ZAP XR |
| H0123 | Human Fetal Dura Mater | Human Fetal Dura Mater | Brain | | | Uni-ZAP XR |
| H0124 | Human Rhabdomyosarcoma | Human Rhabdomyosarcoma | Sk Muscle | | disease | Uni-ZAP XR |
| H0125 | Cem cells cyclohexamide treated | Cyclohexamide Treated Cem, Jurkat, Raji, and Supt | Blood | Cell Line | | Uni-ZAP XR |
| H0128 | Jurkat cells, thiouridine activated | Jurkat Cells | | | | Uni-ZAP XR |
| H0129 | Jurkat cells, thiouridine activated, fract II | Jurkat Cells | | | | Uni-ZAP XR |
| H0130 | LNCAP untreated | LNCAP Cell Line | Prostate | Cell Line | | Uni-ZAP XR |
| H0131 | LNCAP + 0.3 nM R1881 | LNCAP Cell Line | Prostate | Cell Line | | Uni-ZAP XR |
| H0132 | LNCAP + 30 nM R1881 | LNCAP Cell Line | Prostate | Cell Line | | Uni-ZAP XR |
| H0134 | Raji Cells, cyclohexamide treated | Cyclohexamide Treated Cem, Jurkat, Raji, and Supt | Blood | Cell Line | | Uni-ZAP XR |
| H0135 | Human Synovial Sarcoma | Human Synovial Sarcoma | Synovium | | | Uni-ZAP XR |
| H0136 | Supt Cells, cyclohexamide treated | Cyclohexamide Treated Cem, Jurkat, Raji, and Supt | Blood | Cell Line | | Uni-ZAP XR |

TABLE 4-continued

| Code | Description | Tissue | Organ | Cell Line | Disease | Vector |
|---|---|---|---|---|---|---|
| H0138 | Activated T-Cells, 0 hrs. | Activated T-Cells | Blood | Cell Line | | Uni-ZAP XR |
| H0139 | Activated T-Cells, 4 hrs. | Activated T-Cells | Blood | Cell Line | | Uni-ZAP XR |
| H0140 | Activated T-Cells, 8 hrs. | Activated T-Cells | Blood | Cell Line | | Uni-ZAP XR |
| H0141 | Activated T-Cells, 12 hrs. | Activated T-Cells | Blood | Cell Line | | Uni-ZAP XR |
| H0142 | MCF7 Cell Line | MCF7 Cell line | Breast | Cell Line | | Uni-ZAP XR |
| H0144 | Nine Week Old Early Stage Human | 9 Wk Old Early Stage Human | Embryo | | | Uni-ZAP XR |
| H0147 | Human Adult Liver | Human Adult Liver | Liver | | | Uni-ZAP XR |
| H0149 | 7 Week Old Early Stage Human, subtracted | Human Whole 7 Week Old Embryo | Embryo | | | Uni-ZAP XR |
| H0150 | Human Epididymus | Epididymis | Testis | | | Uni-ZAP XR |
| H0151 | Early Stage Human Liver | Human Fetal Liver | Liver | | | Uni-ZAP XR |
| H0152 | Early Stage Human Liver, fract (II) | Human Fetal Liver | Liver | | | Uni-ZAP XR |
| H0154 | Human Fibrosarcoma | Human Skin Fibrosarcoma | Skin | | disease | Uni-ZAP XR |
| H0155 | Human Thymus, subtracted | Human Thymus Tumor | Thymus | | | pBluescript |
| H0156 | Human Adrenal Gland Tumor | Human Adrenal Gland Tumor | Adrenal Gland | | disease | Uni-ZAP XR |
| H0157 | Activated T-Cells, 0 hrs, ligation 2 | Activated T-Cells | Blood | Cell Line | | Uni-ZAP XR |
| H0158 | Activated T-Cells, 4 hrs., ligation 2 | Activated T-Cells | Blood | Cell Line | | Uni-ZAP XR |
| H0159 | Activated T-Cells, 8 hrs., ligation 2 | Activated T-Cells | Blood | Cell Line | | Uni-ZAP XR |
| H0160 | Activated T-Cells, 12 hrs., ligation 2 | Activated T-Cells | Blood | Cell Line | | Uni-ZAP XR |
| H0161 | Activated T-Cells, 24 hrs., ligation 2 | Activated T-Cells | Blood | Cell Line | | Uni-ZAP XR |
| H0163 | Human Synovium | Human Synovium | Synovium | | | Uni-ZAP XR |
| H0164 | Human Trachea Tumor | Human Trachea Tumor | Trachea | | disease | Uni-ZAP XR |
| H0165 | Human Prostate Cancer, Stage B2 | Human Prostate Cancer, stage B2 | Prostate | | disease | Uni-ZAP XR |
| H0166 | Human Prostate Cancer, Stage B2 fraction | Human Prostate Cancer, stage B2 | Prostate | | disease | Uni-ZAP XR |
| H0167 | Activated T-Cells, 24 hrs. | Activated T-Cells | Blood | Cell Line | | Uni-ZAP XR |
| H0168 | Human Prostate Cancer, Stage C | Human Prostate Cancer, stage C | Prostate | | disease | Uni-ZAP XR |
| H0169 | Human Prostate Cancer, Stage C fraction | Human Prostate Cancer, stage C | Prostate | | disease | Uni-ZAP XR |
| H0170 | 12 Week Old Early Stage Human | Twelve Week Old Early Stage Human | Embryo | | | Uni-ZAP XR |
| H0171 | 12 Week Old Early Stage Human, II | Twelve Week Old Early Stage Human | Embryo | | | Uni-ZAP XR |
| H0172 | Human Fetal Brain, random primed | Human Fetal Brain | Brain | | | Lambda ZAP II |
| H0173 | Human Cardiomyopathy, RNA remake | Human Cardiomyopathy | Heart | | disease | Uni-ZAP XR |
| H0175 | H. Adult Spleen, ziplox | | | | | pSport1 |
| H0176 | CAMA1Ee Cell Line | CAMA1Ee Cell Line | Breast | Cell Line | | Uni-ZAP XR |
| H0177 | CAMA1Ee Cell Line | CAMA1Ee Cell Line | Breast | Cell Line | | Uni-ZAP XR |
| H0178 | Human Fetal Brain | Human Fetal Brain | Brain | | | Uni-ZAP XR |
| H0179 | Human Neutrophil | Human Neutrophil | Blood | Cell Line | | Uni-ZAP XR |
| H0180 | Human Primary Breast Cancer | Human Primary Breast Cancer | Breast | | disease | Uni-ZAP XR |
| H0181 | Human Primary Breast Cancer | Human Primary Breast Cancer | Breast | | disease | Uni-ZAP XR |
| H0182 | Human Primary Breast Cancer | Human Primary Breast Cancer | Breast | | disease | Uni-ZAP XR |
| H0183 | Human Colon Cancer | Human Colon Cancer | Colon | | disease | Uni-ZAP XR |
| H0184 | Human Colon Cancer, metasticized to live | Human Colon Cancer, metasticized to liver | Liver | | disease | Lambda ZAP II |
| H0185 | Activated T-Cell labeled with 4-thioluri | T-Cells | Blood | Cell Line | | Lambda ZAP II |
| H0187 | Resting T-Cell | T-Cells | Blood | Cell Line | | Lambda ZAP II |
| H0188 | Human Normal Breast | Human Normal Breast | Breast | | | Uni-ZAP XR |
| H0189 | Human Resting Macrophage | Human Macrophage/Monocytes | Blood | Cell Line | | Uni-ZAP XR |
| H0190 | Human Activated Macrophage (LPS) | Human Macrophage/Monocytes | Blood | Cell Line | | Uni-ZAP XR |
| H0191 | Human Activated Macrophage (LPS), thiour | Human Macrophage/Monocytes | Blood | Cell Line | | Uni-ZAP XR |

TABLE 4-continued

| Code | Description | Tissue | Organ | Cell Line | Disease | Vector |
|---|---|---|---|---|---|---|
| H0192 | Cem Cells, cyclohexamide treated, subtra | Cyclohexamide Treated Cem, Jurkat, Raji, and Supt | Blood | Cell Line | | Uni-ZAP XR |
| H0194 | Human Cerebellum, subtracted | Human Cerebellum | Brain | | | pBluescript |
| H0196 | Human Cardiomyopathy, subtracted | Human Cardiomyopathy | Heart | | | Uni-ZAP XR |
| H0197 | Human Fetal Liver, subtracted | Human Fetal Liver | Liver | | | Uni-ZAP XR |
| H0199 | Human Fetal Liver, subtracted, neg clone | Human Fetal Liver | Liver | | | Uni-ZAP XR |
| H0200 | Human Greater Omentum, fract II remake, | Human Greater Omentum | peritoneum | | | Uni-ZAP XR |
| H0201 | Human Hippocampus, subtracted | Human Hippocampus | Brain | | | pBluescript |
| H0202 | Jurkat Cells, cyclohexamide treated, subtraction | Cyclohexamide Treated Cem, Jurkat, Raji, and Supt | Blood | Cell Line | | Uni-ZAP XR |
| H0203 | Jurkat Cells, cyclohexamide treated, dif | Cyclohexamide Treated Cem, Jurkat, Raji, and Supt | Blood | Cell Line | | Uni-ZAP XR |
| H0204 | Human Colon Cancer, subtracted | Human Colon Cancer | Colon | | | pBluescript |
| H0205 | Human Colon Cancer, differential | Human Colon Cancer | Colon | | | pBluescript |
| H0207 | LNCAP, differential expression | LNCAP Cell Line | Prostate | Cell Line | | pBluescript |
| H0208 | Early Stage Human Lung, subtracted | Human Fetal Lung | Lung | | | pBluescript |
| H0209 | Human Cerebellum, differentially expressed | Human Cerebellum | Brain | | | Uni-ZAP XR |
| H0211 | Human Prostate, differential expression | Human Prostate | Prostate | | | pBluescript |
| H0212 | Human Prostate, subtracted | Human Prostate | Prostate | | | pBluescript |
| H0213 | Human Pituitary, subtracted | Human Pituitary | | | | Uni-ZAP XR |
| H0214 | Raji cells, cyclohexamide treated, subtracted | Cyclohexamide Treated Cem, Jurkat, Raji, and Supt | Blood | Cell Line | | pBluescript |
| H0215 | Raji cells, cyclohexamide treated, differentially expressed | Cyclohexamide Treated Cem, Jurkat, Raji, and Supt | Blood | Cell Line | | pBluescript |
| H0216 | Supt cells, cyclohexamide treated, subtracted | Cyclohexamide Treated Cem, Jurkat, Raji, and Supt | Blood | Cell Line | | pBluescript |
| H0217 | Supt cells, cyclohexamide treated, differentially expressed | Cyclohexamide Treated Cem, Jurkat, Raji, and Supt | Blood | Cell Line | | pBluescript |
| H0218 | Activated T-Cells, 0 hrs, subtracted | Activated T-Cells | Blood | Cell Line | | Uni-ZAP XR |
| H0219 | Activated T-Cells, 0 hrs, differentially expressed | Activated T-Cells | Blood | Cell Line | | Uni-ZAP XR |
| H0220 | Activated T-Cells, 4 hrs, subtracted | Activated T-Cells | Blood | Cell Line | | Uni-ZAP XR |
| H0221 | Activated T-Cells, 4 hrs, differentially expressed | Activated T-Cells | Blood | Cell Line | | Uni-ZAP XR |
| H0222 | Activated T-Cells, 8 hrs, subtracted | Activated T-Cells | Blood | Cell Line | | Uni-ZAP XR |
| H0223 | Activated T-Cells, 8 hrs, differentially expressed | Activated T-Cells | Blood | Cell Line | | Uni-ZAP XR |
| H0224 | Activated T-Cells, 12 hrs, subtracted | Activated T-Cells | Blood | Cell Line | | Uni-ZAP XR |
| H0225 | Activated T-Cells, 12 hrs, differentially expressed | Activated T-Cells | Blood | Cell Line | | Uni-ZAP XR |
| H0228 | C7MCF7 cell line, estrogen treated | C7MCF7 Cell Line, estrogen treated | Breast | Cell Line | | Uni-ZAP XR |
| H0229 | Early Stage Human Brain, random primed | Early Stage Human Brain | Brain | | | Lambda ZAP II |
| H0230 | Human Cardiomyopathy, diff exp | Human Cardiomyopathy | Heart | | disease | Uni-ZAP XR |
| H0231 | Human Colon, subtraction | Human Colon | | | | pBluescript |
| H0232 | Human Colon, differential expression | Human Colon | | | | pBluescript |

TABLE 4-continued

| Code | Description | Tissue | Organ | Cell Line | Disease | Vector |
|------|-------------|--------|-------|-----------|---------|--------|
| H0233 | Human Fetal Heart, Differential (Adult-Specific) | Human Fetal Heart | Heart | | | pBluescript |
| H0234 | human colon cancer, metastatic to liver, differentially expressed | Human Colon Cancer, metasticized to liver | Liver | | | pBluescript |
| H0235 | Human colon cancer, metaticized to liver, subtraction | Human Colon Cancer, metasticized to liver | Liver | | | pBluescript |
| H0238 | Human Myometrium Leiomyoma | Human Myometrium Leiomyoma | Uterus | | disease | Uni-ZAP XR |
| H0239 | Human Kidney Tumor | Human Kidney Tumor | Kidney | | disease | Uni-ZAP XR |
| H0240 | C7MCF7 cell line, estrogen treated, Differential | C7MCF7 Cell Line, estrogen treated | Breast | Cell Line | | Uni-ZAP XR |
| H0241 | C7MCF7 cell line, estrogen treated, subtraction | C7MCF7 Cell Line, estrogen treated | Breast | Cell Line | | Uni-ZAP XR |
| H0242 | Human Fetal Heart, Differential (Fetal-Specific) | Human Fetal Heart | Heart | | | pBluescript |
| H0244 | Human 8 Week Whole Embryo, subtracted | Human 8 Week Old Embryo | Embryo | | | Uni-ZAP XR |
| H0246 | Human Fetal Liver-Enzyme subtraction | Human Fetal Liver | Liver | | | Uni-ZAP XR |
| H0247 | Human Membrane Bound Polysomes-Enzyme Subtraction | Human Membrane Bound Polysomes | Blood | Cell Line | | Uni-ZAP XR |
| H0249 | HE7, subtracted by hybridization with E7 cDNA | Human Whole 7 Week Old Embryo | Embryo | | | Uni-ZAP XR |
| H0250 | Human Activated Monocytes | Human Monocytes | | | | Uni-ZAP XR |
| H0251 | Human Chondrosarcoma | Human Chondrosarcoma | Cartilage | | disease | Uni-ZAP XR |
| H0252 | Human Osteosarcoma | Human Osteosarcoma | Bone | | disease | Uni-ZAP XR |
| H0253 | Human adult testis, large inserts | Human Adult Testis | Testis | | | Uni-ZAP XR |
| H0254 | Breast Lymph node cDNA library | Breast Lymph Node | Lymph Node | | | Uni-ZAP XR |
| H0255 | breast lymph node CDNA library | Breast Lymph Node | Lymph Node | | | Lambda ZAP II |
| H0256 | HL-60, unstimulated | Human HL-60 Cells, unstimulated | Blood | Cell Line | | Uni-ZAP XR |
| H0257 | HL-60, PMA 4H | HL-60 Cells, PMA stimulated 4H | Blood | Cell Line | | Uni-ZAP XR |
| H0261 | H. cerebellum, Enzyme subtracted | Human Cerebellum | Brain | | | Uni-ZAP XR |
| H0263 | human colon cancer | Human Colon Cancer | Colon | | disease | Lambda ZAP II |
| H0264 | human tonsils | Human Tonsil | Tonsil | | | Uni-ZAP XR |
| H0265 | Activated T-Cell (12 hs)/Thiouridine labelledEco | T-Cells | Blood | Cell Line | | Uni-ZAP XR |
| H0266 | Human Microvascular Endothelial Cells, fract. A | HMEC | Vein | Cell Line | | Lambda ZAP II |
| H0267 | Human Microvascular Endothelial Cells, fract. B | HMEC | Vein | Cell Line | | Lambda ZAP II |
| H0268 | Human Umbilical Vein Endothelial Cells, fract. A | HUVE Cells | Umbilical vein | Cell Line | | Lambda ZAP II |
| H0269 | Human Umbilical Vein Endothelial Cells, fract. B | HUVE Cells | Umbilical vein | Cell Line | | Lambda ZAP II |
| H0270 | HPAS (human pancreas, subtracted) | Human Pancreas | Pancreas | | | Uni-ZAP XR |
| H0271 | Human Neutrophil, Activated | Human Neutrophil - Activated | Blood | Cell Line | | Uni-ZAP XR |
| H0272 | HUMAN TONSILS, FRACTION 2 | Human Tonsil | Tonsil | | | Uni-ZAP XR |
| H0274 | Human Adult Spleen, fractionII | Human Adult Spleen | Spleen | | | Uni-ZAP XR |
| H0275 | Human Infant Adrenal Gland, Subtracted | Human Infant Adrenal Gland | Adrenal gland | | | pBluescript |
| H0279 | K562 cells | K562 Cell line | cell line | Cell Line | | ZAP Express |
| H0280 | K562 + PMA (36 hrs) | K562 Cell line | cell line | Cell Line | | ZAP Express |

TABLE 4-continued

| Code | Description | Tissue | Organ | Cell Line | Disease | Vector |
|---|---|---|---|---|---|---|
| H0281 | Lymph node, abnorm. cell line (ATCC ™ #7225) | Lymph Node, abnormal cell line | Lymph Node | Cell Line | | ZAP Express |
| H0282 | HBGB"s differential consolidation | Human Primary Breast Cancer | Breast | | | Uni-ZAP XR |
| H0284 | Human OB MG63 control fraction I | Human Osteoblastoma MG63 cell line | Bone | Cell Line | | Uni-ZAP XR |
| H0286 | Human OB MG63 treated (10 nM E2) fraction I | Human Osteoblastoma MG63 cell line | Bone | Cell Line | | Uni-ZAP XR |
| H0288 | Human OB HOS control fraction I | Human Osteoblastoma HOS cell line | Bone | Cell Line | | Uni-ZAP XR |
| H0290 | Human OB HOS treated (1 nM E2) fraction I | Human Osteoblastoma HOS cell line | Bone | Cell Line | | Uni-ZAP XR |
| H0292 | Human OB HOS treated (10 nM E2) fraction I | Human Osteoblastoma HOS cell line | Bone | Cell Line | | Uni-ZAP XR |
| H0293 | WI 38 cells | | | | | |
| H0294 | Amniotic Cells - TNF induced | Amniotic Cells - TNF induced | Placenta | Cell Line | | Uni-ZAP XR |
| H0295 | Amniotic Cells - Primary Culture | Amniotic Cells - Primary Culture | Placenta | Cell Line | | Uni-ZAP XR |
| H0298 | HCBB"s differential consolidation | CAMA1Ee Cell Line | Breast | Cell Line | | Uni-ZAP XR |
| H0299 | HCBA"s differential consolidation | CAMA1Ee Cell Line | Breast | Cell Line | | Uni-ZAP XR |
| H0300 | CD34 positive cells (Cord Blood) | CD34 Positive Cells | Cord Blood | | | ZAP Express |
| H0305 | CD34 positive cells (Cord Blood) | CD34 Positive Cells | Cord Blood | | | ZAP Express |
| H0306 | CD34 depleted Buffy Coat (Cord Blood) | CD34 Depleted Buffy Coat (Cord Blood) | Cord Blood | | | ZAP Express |
| H0309 | Human Chronic Synovitis | Synovium, Chronic Synovitis/Osteoarthritis | Synovium | | disease | Uni-ZAP XR |
| H0310 | human caudate nucleus | Brain | Brain | | | Uni-ZAP XR |
| H0313 | human pleural cancer | pleural cancer | | | disease | pBluescript |
| H0316 | HUMAN STOMACH | Human Stomach | Stomach | | | Uni-ZAP XR |
| H0318 | HUMAN B CELL LYMPHOMA | Human B Cell Lymphoma | Lymph Node | | disease | Uni-ZAP XR |
| H0320 | Human frontal cortex | Human Frontal Cortex | Brain | | | Uni-ZAP XR |
| H0321 | HUMAN SCHWANOMA | Schwanoma | Nerve | | disease | Uni-ZAP XR |
| H0327 | human corpus colosum | Human Corpus Callosum | Brain | | | Uni-ZAP XR |
| H0328 | human ovarian cancer | Ovarian Cancer | Ovary | | disease | Uni-ZAP XR |
| H0329 | Dermatofibrosarcoma Protuberance | Dermatofibrosarcoma Protuberans | Skin | | disease | Uni-ZAP XR |
| H0330 | HCBB"s Subtractive (mito genes) | CAMA1Ee Cell Line | Breast | Cell Line | | Uni-ZAP XR |
| H0331 | Hepatocellular Tumor | Hepatocellular Tumor | Liver | | disease | Lambda ZAP II |
| H0333 | Hemangiopericytoma | Hemangiopericytoma | Blood vessel | | disease | Lambda ZAP II |
| H0334 | Kidney cancer | Kidney Cancer | Kidney | | disease | Uni-ZAP XR |
| H0339 | Duodenum | Duodenum | | | | Uni-ZAP XR |
| H0340 | Corpus Callosum | Corpus Collosum-93052 | | | | Uni-ZAP XR |
| H0341 | Bone Marrow Cell Line (RS4; 11) | Bone Marrow Cell Line RS4; 11 | Bone Marrow | Cell Line | | Uni-ZAP XR |
| H0342 | Lingual Gyrus | Lingual Gyrus | Brain | | | Uni-Zap XR |
| H0343 | stomach cancer (human) | Stomach Cancer - 5383A (human) | | | disease | Uni-ZAP XR |
| H0344 | Adipose tissue (human) | Adipose - 6825A (human) | | | | Uni-ZAP XR |
| H0345 | SKIN | Skin - 4000868H | Skin | | | Uni-ZAP XR |
| H0346 | Brain-medulloblastoma | Brain (Medulloblastoma)-9405C006R | Brain | | disease | Uni-ZAP XR |
| H0349 | human adult liver cDNA library | Human Adult Liver | Liver | | | pCMVSport 1 |
| H0350 | Human Fetal Liver, mixed 10 & 14 week | Human Fetal Liver, mixed 10 & 14 Week | Liver | | | Uni-ZAP XR |
| H0351 | Glioblastoma | Glioblastoma | Brain | | disease | Uni-ZAP XR |
| H0352 | wilm"s tumor | Wilm"s Tumor | | | disease | Uni-ZAP XR |
| H0354 | Human Leukocytes | Human Leukocytes | Blood | Cell Line | | pCMVSport 1 |
| H0355 | Human Liver | Human Liver, normal Adult | | | | pCMVSport 1 |
| H0356 | Human Kidney | Human Kidney | Kidney | | | pCMVSport 1 |
| H0357 | H. Normalized Fetal Liver, II | Human Fetal Liver | Liver | | | Uni-ZAP XR |
| H0359 | KMH2 cell line | KMH2 | | | | ZAP Express |
| H0360 | Hemangiopericytoma | Hemangiopericytoma | | | disease | |
| H0361 | Human rejected kidney | Human Rejected Kidney | | | disease | pBluescript |

TABLE 4-continued

| Code | Description | Tissue | Organ | Cell Line | Disease | Vector |
|---|---|---|---|---|---|---|
| H0362 | HeLa cell line | HELA CELL LINE | | | | pSport1 |
| H0365 | Osteoclastoma-normalized B | Human Osteoclastoma | | | disease | Uni-ZAP XR |
| H0366 | L428 cell line | L428 | | | | ZAP Express |
| H0369 | H. Atrophic Endometrium | Atrophic Endometrium and myometrium | | | | Uni-ZAP XR |
| H0370 | H. Lymph node breast Cancer | Lymph node with Met. Breast Cancer | | | disease | Uni-ZAP XR |
| H0371 | Eosinophils-Hypereosinophilia patient | Eosinophils-Hypereosinophilia patient | | | disease | Uni-ZAP XR |
| H0372 | Human Testes | Human Testes | Testis | | | pCMVSport 1 |
| H0373 | Human Heart | Human Adult Heart | Heart | | | pCMVSport 1 |
| H0374 | Human Brain | Human Brain | | | | pCMVSport 1 |
| H0375 | Human Lung | Human Lung | | | | pCMVSport 1 |
| H0376 | Human Spleen | Human Adult Spleen | Spleen | | | pCMVSport 1 |
| H0379 | Human Tongue, frac 1 | Human Tongue | | | | pSport1 |
| H0380 | Human Tongue, frac 2 | Human Tongue | | | | pSport1 |
| H0381 | Bone Cancer | Bone Cancer | | | disease | Uni-ZAP XR |
| H0383 | Human Prostate BPH, re-excision | Human Prostate BPH | | | | Uni-ZAP XR |
| H0384 | Brain, Kozak | Human Brain | | | | pCMVSport 1 |
| H0386 | Leukocyte and Lung; 4 screens | Human Leukocytes | Blood | Cell Line | | pCMVSport 1 |
| H0388 | Human Rejected Kidney, 704 re-excision | Human Rejected Kidney | | | disease | pBluescript |
| H0389 | H. Brain, X-Chromosome hybridization | Human Brain | | | | pCMVSport 1 |
| H0390 | Human Amygdala Depression, re-excision | Human Amygdala Depression | | | disease | pBluescript |
| H0391 | H. Meningima, M6 | Human Meningima | brain | | | pSport1 |
| H0392 | H. Meningima, M1 | Human Meningima | brain | | | pSport1 |
| H0393 | Fetal Liver, subtraction II | Human Fetal Liver | Liver | | | pBluescript |
| H0394 | A-14 cell line | Redd-Sternberg cell | | | | ZAP Express |
| H0395 | A1-CELL LINE | Redd-Sternberg cell | | | | ZAP Express |
| H0396 | L1 Cell line | Redd-Sternberg cell | | | | ZAP Express |
| H0398 | Human Newborn Bladder | Human Newborn Bladder | | | | pBluescript |
| H0399 | Human Kidney Cortex, re-rescue | Human Kidney Cortex | | | | Lambda ZAP II |
| H0400 | Human Striatum Depression, re-rescue | Human Brain, Striatum Depression | Brain | | | Lambda ZAP II |
| H0401 | Human Pituitary, subtracted V | Human Pituitary | | | | pBluescript |
| H0402 | CD34 depleted Buffy Coat (Cord Blood), re-excision | CD34 Depleted Buffy Coat (Cord Blood) | Cord Blood | | | ZAP Express |
| H0403 | H. Umbilical Vein Endothelial Cells, IL4 induced | HUVE Cells | Umbilical vein | Cell Line | | Uni-ZAP XR |
| H0404 | H. Umbilical Vein endothelial cells, uninduced | HUVE Cells | Umbilical vein | Cell Line | | Uni-ZAP XR |
| H0405 | Human Pituitary, subtracted VI | Human Pituitary | | | | pBluescript |
| H0406 | H Amygdala Depression, subtracted | Human Amygdala Depression | | | | Uni-ZAP XR |
| H0408 | Human kidney Cortex, subtracted | Human Kidney Cortex | | | | pBluescript |
| H0409 | H. Striatum Depression, subtracted | Human Brain, Striatum Depression | Brain | | | pBluescript |
| H0410 | H. Male bladder, adult | H Male Bladder, Adult | Bladder | | | pSport1 |
| H0411 | H Female Bladder, Adult | Human Female Adult Bladder | Bladder | | | pSport1 |
| H0412 | Human umbilical vein endothelial cells, IL-4 induced | HUVE Cells | Umbilical vein | Cell Line | | pSport1 |
| H0413 | Human Umbilical Vein Endothelial Cells, uninduced | HUVE Cells | Umbilical vein | Cell Line | | pSport1 |
| H0414 | Ovarian Tumor I, OV5232 | Ovarian Tumor, OV5232 | Ovary | | disease | pSport1 |
| H0415 | H. Ovarian Tumor, II, OV5232 | Ovarian Tumor, OV5232 | Ovary | | disease | pCMVSport 2.0 |
| H0416 | Human Neutrophils, Activated, re-excision | Human Neutrophil-Activated | Blood | Cell Line | | pBluescript |

TABLE 4-continued

| Code | Description | Tissue | Organ | Cell Line | Disease | Vector |
|---|---|---|---|---|---|---|
| H0417 | Human Pituitary, subtracted VIII | Human Pituitary | | | | pBluescript |
| H0418 | Human Pituitary, subtracted VII | Human Pituitary | | | | pBluescript |
| H0419 | Bone Cancer, re-excision | Bone Cancer | | | | Uni-ZAP XR |
| H0421 | Human Bone Marrow, re-excision | Bone Marrow | | | | pBluescript |
| H0422 | T-Cell PEA 16 hrs | T-Cells | Blood | Cell Line | | pSport1 |
| H0423 | T-Cell PHA 24 hrs | T-Cells | Blood | Cell Line | | pSport1 |
| H0424 | Human Pituitary, subt IX | Human Pituitary | | | | pBluescript |
| H0427 | Human Adipose | Human Adipose, left hiplipoma | | | | pSport1 |
| H0428 | Human Ovary | Human Ovary Tumor | Ovary | | | pSport1 |
| H0429 | K562 + PMA (36 hrs), re-excision | K562 Cell line | cell line | Cell Line | | ZAP Express |
| H0431 | H. Kidney Medulla, re-excision | Kidney medulla | Kidney | | | pBluescript |
| H0432 | H. Kidney Pyramid | Kidney pyramids | Kidney | | | pBluescript |
| H0433 | Human Umbilical Vein Endothelial cells, frac B, re-excision | HUVE Cells | Umbilical vein | Cell Line | | pBluescript |
| H0434 | Human Brain, striatum, re-excision | Human Brain, Striatum | | | | pBluescript |
| H0435 | Ovarian Tumor 10-3-95 | Ovarian Tumor, OV350721 | Ovary | | | pCMVSport 2.0 |
| H0436 | Resting T-Cell Library, II | T-Cells | Blood | Cell Line | | pSport1 |
| H0437 | H Umbilical Vein Endothelial Cells, frac A, re-excision | HUVE Cells | Umbilical vein | Cell Line | | Lambda ZAP II |
| H0438 | H. Whole Brain #2, re-excision | Human Whole Brain #2 | | | | ZAP Express |
| H0439 | Human Eosinophils | Eosinophils | | | | pBluescript |
| H0440 | FGF enriched mixed library | Mixed libraries | | | | pCMVSport 1 |
| H0441 | H. Kidney Cortex, subtracted | Kidney cortex | Kidney | | | pBluescript |
| H0442 | H. Striatum Depression, subt II | Human Brain, Striatum Depression | Brain | | | pBluescript |
| H0443 | H. Adipose, subtracted | Human Adipose, left hiplipoma | | | | pSport1 |
| H0444 | Spleen metastic melanoma | Spleen, Metastic malignant melanoma | Spleen | | disease | pSport1 |
| H0445 | Spleen, Chronic lymphocytic leukemia | Human Spleen, CLL | Spleen | | disease | pSport1 |
| H0447 | Salivary gland, re-excision | Human Salivary Gland | Salivary gland | | | Uni-ZAP XR |
| H0448 | Salivary gland, subtracted | Human Salivary Gland | Salivary gland | | | Lambda ZAP II |
| H0449 | CD34 + cell, I | CD34 positive cells | | | | pSport1 |
| H0450 | CD34 + cells, II | CD34 positive cells | | | | pCMVSport 2.0 |
| H0453 | H. Kidney Pyramid, subtracted | Kidney pyramids | Kidney | | | pBluescript |
| H0455 | H. Striatum Depression, subt | Human Brain, Striatum Depression | Brain | | | pBluescript |
| H0456 | H Kidney Cortex, subtracted III | Human Kidney Cortex | | | | pBluescript |
| H0457 | Human Eosinophils | Human Eosinophils | | | | pSport1 |
| H0458 | CD34 + cell, I, frac II | CD34 positive cells | | | | pSport1 |
| H0459 | CD34 + cells, II, FRACTION 2 | CD34 positive cells | | | | pCMVSport 2.0 |
| H0461 | H. Kidney Medulla, subtracted | Kidney medulla | Kidney | | | pBluescript |
| H0462 | H. Amygdala Depression, subtracted | | Brain | | | pBluescript |
| H0477 | Human Tonsil, Lib 3 | Human Tonsil | Tonsil | | | pSport1 |
| H0478 | Salivary Gland, Lib 2 | Human Salivary Gland | Salivary gland | | | pSport1 |
| H0479 | Salivary Gland, Lib 3 | Human Salivary Gland | Salivary gland | | | pSport1 |
| H0480 | L8 cell line | L8 cell line | | | | ZAP Express |
| H0483 | Breast Cancer cell line, MDA 36 | Breast Cancer Cell line, MDA 36 | | | | pSport1 |
| H0484 | Breast Cancer Cell line, angiogenic | Breast Cancer Cell line, Angiogenic, 36T3 | | | | pSport1 |
| H0485 | Hodgkin"s Lymphoma I | Hodgkin"s Lymphoma I | | | disease | pCMVSport 2.0 |
| H0486 | Hodgkin"s Lymphoma II | Hodgkin"s Lymphoma II | | | disease | pCMVSport 2.0 |
| H0487 | Human Tonsils, lib I | Human Tonsils | | | | pCMVSport 2.0 |

TABLE 4-continued

| Code | Description | Tissue | Organ | Cell Line | Disease | Vector |
|---|---|---|---|---|---|---|
| H0488 | Human Tonsils, Lib 2 | Human Tonsils | | | | pCMVSport 2.0 |
| H0489 | Crohn"s Disease | Ileum | Intestine | | disease | pSport1 |
| H0490 | Hl-60, untreated, subtracted | Human HL-60 Cells, unstimulated | Blood | Cell Line | | Uni-ZAP XR |
| H0491 | HL-60, PMA 4 H, subtracted | HL-60 Cells, PMA stimulated 4 H | Blood | Cell Line | | Uni-ZAP XR |
| H0492 | HL-60, RA 4 h, Subtracted | HL-60 Cells, RA stimulated for 4 H | Blood | Cell Line | | Uni-ZAP XR |
| H0494 | Keratinocyte | Keratinocyte | | | | pCMVSport 2.0 |
| H0497 | HEL cell line | HEL cell line | | HEL 92.1.7 | | pSport1 |
| H0505 | Human Astrocyte | Human Astrocyte | | | | pSport1 |
| H0506 | Ulcerative Colitis | Colon | Colon | | | pSport1 |
| H0509 | Liver, Hepatoma | Human Liver, Hepatoma, patient 8 | Liver | | disease | pCMVSport 3.0 |
| H0510 | Human Liver, normal | Human Liver, normal, Patient #8 | Liver | | | pCMVSport 3.0 |
| H0512 | Keratinocyte, lib 3 | Keratinocyte | | | | pCMVSport 2.0 |
| H0517 | Nasal polyps | Nasal polyps | | | | pCMVSport 2.0 |
| H0518 | pBMC stimulated w/ poly I/C | pBMC stimulated with poly I/C | | | | pCMVSport 3.0 |
| H0519 | NTERA2, control | NTERA2, Teratocarcinoma cell line | | | | pCMVSport 3.0 |
| H0520 | NTERA2 + retinoic acid, 14 days | NTERA2, Teratocarcinoma cell line | | | | pSport1 |
| H0521 | Primary Dendritic Cells, lib 1 | Primary Dendritic cells | | | | pCMVSport 3.0 |
| H0522 | Primary Dendritic cells, frac 2 | Primary Dendritic cells | | | | pCMVSport 3.0 |
| H0523 | Primary Dendritic cells, CapFinder2, frac 1 | Primary Dendritic cells | | | | pSport1 |
| H0524 | Primary Dendritic Cells, CapFinder, frac 2 | Primary Dendritic cells | | | | pSport1 |
| H0525 | PCR, pBMC I/C treated | pBMC stimulated with poly I/C | | | | PCRII |
| H0528 | Poly[I]/Poly[C] Normal Lung Fibroblasts | Poly [I]/Poly[C] Normal Lung Fibroblasts | | | | pCMVSport 3.0 |
| H0529 | Myoloid Progenitor Cell Line | TF-1 Cell Line; Myoloid progenitor cell line | | | | pCMVSport 3.0 |
| H0530 | Human Dermal Endothelial Cells, untreated | Human Dermal Endothelial Cells; untreated | | | | pSport1 |
| H0533 | Human Stromal endometrial fibroblasts, treated w/ estradiol | Human Stromal endometrial fibroblasts, treated wit | | | | pSport1 |
| H0535 | Human ovary tumor cell OV350721 | Ovarian Tumor, OV350721 | Ovary | | disease | pSport1 |
| H0537 | H. Primary Dendritic Cells, lib 3 | Primary Dendritic cells | | | | pCMVSport 2.0 |
| H0538 | Merkel Cells | Merkel cells | Lymph node | | | pSport1 |
| H0539 | Pancreas Islet Cell Tumor | Pancreas Islet Cell Tumour | Pancreas | | disease | pSport1 |
| H0540 | Skin, burned | Skin, leg burned | Skin | | | pSport1 |
| H0542 | T Cell helper I | Helper T cell | | | | pCMVSport 3.0 |
| H0543 | T cell helper II | Helper T cell | | | | pcMVSport 3.0 |
| H0544 | Human endometrial stromal cells | Human endometrial stromal cells | | | | pCMVSport 3.0 |
| H0545 | Human endometrial stromal cells-treated with progesterone | Human endometrial stromal cells-treated with proge | | | | pCMVSport 3.0 |
| H0546 | Human endometrial stromal cells-treated with estradiol | Human endometrial stromal cells-treated with estra | | | | pCMVSport 3.0 |
| H0547 | NTERA2 teratocarcinoma cell line + retinoic acid (14 days) | NTERA2, Teratocarcinoma cell line | | | | pSport1 |
| H0548 | Human Skin Fibroblasts, normal | Human Skin Fibroblasts | | | | pBluescript |
| H0549 | H. Epididiymus, caput & corpus | Human Epididiymus, caput and corpus | | | | Uni-ZAP XR |
| H0550 | H. Epididiymus, cauda | Human Epididiymus, cauda | | | | Uni-ZAP XR |
| H0551 | Human Thymus Stromal Cells | Human Thymus Stromal Cells | | | | pCMVSport 3.0 |
| H0552 | Signal trap, Femur Bone Marrow, pooled | Femur Bone marrow, pooled from 8 male/female | | | | Other |
| H0553 | Human Placenta | Human Placenta | | | | pCMVSport 3.0 |

TABLE 4-continued

| Code | Description | Tissue | Organ | Cell Line | Disease | Vector |
|---|---|---|---|---|---|---|
| H0555 | Rejected Kidney, lib 4 | Human Rejected Kidney | Kidney | | disease | pCMVSport 3.0 |
| H0556 | Activated T-cell(12 h)/Thiouridine-re-excision | T-Cells | Blood | Cell Line | | Uni-ZAP XR |
| H0559 | HL-60, PMA 4H, re-excision | HL-60 Cells, PMA stimulated 4H | Blood | Cell Line | | Uni-ZAP XR |
| H0560 | KMH2 | KMH2 | | | | pCMVSport 3.0 |
| H0561 | L428 | L428 | | | | pCMVSport 3.0 |
| H0562 | Human Fetal Brain, normalized c5-11-26 | Human Fetal Brain | | | | pCMVSport 2.0 |
| H0563 | Human Fetal Brain, normalized 50021F | Human Fetal Brain | | | | pCMVSport 2.0 |
| H0564 | Human Fetal Brain, normalized C5001F | Human Fetal Brain | | | | pCMVSport 2.0 |
| H0565 | HUman Fetal Brain, normalized 100024F | Human Fetal Brain | | | | pCMVSport 2.0 |
| H0566 | Human Fetal Brain, normalized c50F | Human Fetal Brain | | | | pCMVSport 2.0 |
| H0567 | Human Fetal Brain, normalized A5002F | Human Fetal Brain | | | | pCMVSport 2.0 |
| H0569 | Human Fetal Brain, normalized CO | Human Fetal Brain | | | | pCMVSport 2.0 |
| H0570 | Human Fetal Brain, normalized C500H | Human Fetal Brain | | | | pCMVSport 2.0 |
| H0571 | Human Fetal Brain, normalized C500HE | Human Fetal Brain | | | | pCMVSport 2.0 |
| H0572 | Human Fetal Brain, normalized AC5002 | Human Fetal Brain | | | | pCMVSport 2.0 |
| H0574 | Hepatocellular Tumor; re-excision | Hepatocellular Tumor | Liver | | disease | Lambda ZAP II |
| H0575 | Human Adult Pulmonary; re-excision | Human Adult Pulmonary | Lung | | | Uni-ZAP XR |
| H0576 | Resting T-Cell; re-excision | T-Cells | Blood | Cell Line | | Lambda ZAP II |
| H0578 | Human Fetal Thymus | Fetal Thymus | Thymus | | | pSport1 |
| H0579 | Pericardium | Pericardium | Heart | | | pSport1 |
| H0580 | Dendritic cells, pooled | Pooled dendritic cells | | | | pCMVSport 3.0 |
| H0581 | Human Bone Marrow, treated | Human Bone Marrow | Bone Marrow | | | pCMVSport 3.0 |
| H0583 | B Cell lymphoma | B Cell Lymphoma | B Cell | | disease | pCMVSport 3.0 |
| H0584 | Activated T-cells, 24 hrs, re-excision | Activated T-Cells | Blood | Cell Line | | Uni-ZAP XR |
| H0585 | Activated T-Cells, 12 hrs, re-excision | Activated T-Cells | Blood | Cell Line | | Uni-ZAP XR |
| H0586 | Healing groin wound, 6.5 hours post incision | healing groin wound, 6.5 hours post incision - 2/ | groin | | disease | pCMVSport 3.0 |
| H0587 | Healing groin wound; 7.5 hours post incision | Groin-2/19/97 | groin | | disease | pCMVSport 3.0 |
| H0589 | CD34 positive cells (cord blood), re-ex | CD34 Positive Cells | Cord Blood | | | ZAP Express |
| H0590 | Human adult small intestine, re-excision | Human Adult Small Intestine | Small Int. | | | Uni-ZAP XR |
| H0591 | Human T-cell lymphoma; re-excision | T-Cell Lymphoma | T-Cell | | disease | Uni-ZAP XR |
| H0592 | Healing groin wound - zero hr post-incision (control) | HGS wound healing project; abdomen | | | disease | pCMVSport 3.0 |
| H0593 | Olfactory epithelium; nasalcavity | Olfactory epithelium from roof of left nasal cacit | | | | pCMVSport 3.0 |
| H0594 | Human Lung Cancer; re-excision | Human Lung Cancer | Lung | | disease | Lambda ZAP II |
| H0595 | Stomach cancer (human); re-excision | Stomach Cancer - 5383A (human) | | | disease | Uni-ZAP XR |
| H0596 | Human Colon Cancer; re-excision | Human Colon Cancer | Colon | | | Lambda ZAP II |
| H0597 | Human Colon; re-excision | Human Colon | | | | Lambda ZAP II |
| H0598 | Human Stomach; re-excision | Human Stomach | Stomach | | | Uni-ZAP II |
| H0599 | Human Adult Heart; re-excision | Human Adult Heart | Heart | | | Uni-ZAP II |
| H0600 | Healing Abdomen wound; 70 & 90 min post incision | Abdomen | | | disease | pCMVSport 3.0 |
| H0601 | Healing Abdomen Wound; 15 days post incision | Abdomen | | | disease | pCMVSport 3.0 |

TABLE 4-continued

| Code | Description | Tissue | Organ | Cell Line | Disease | Vector |
|---|---|---|---|---|---|---|
| H0602 | Healing Abdomen Wound; 21 & 29 days post incision | Abdomen | | | disease | pCMVSport 3.0 |
| H0604 | Human Pituitary, re-excision | Human Pituitary | | | | pBluescript |
| H0606 | Human Primary Breast Cancer; re-excision | Human Primary Breast Cancer | Breast | | disease | Uni-ZAP XR |
| H0607 | H. Leukocytes, normalized cot 50A3 | H. Leukocytes | | | | pCMVSport 1 |
| H0608 | H. Leukocytes, control | H. Leukocytes | | | | pCMVSport 1 |
| H0609 | H. Leukocytes, normalized cot > 500A | H. Leukocytes | | | | pCMVSport 1 |
| H0610 | H. Leukocytes, normalized cot 5A | H. Leukocytes | | | | pCMVSport 1 |
| H0611 | H. Leukocytes, normalized cot 500 B | H. Leukocytes | | | | pCMVSport 1 |
| H0612 | H. Leukocytes, normalized cot 50 B | H. Leukocytes | | | | pCMVSport 1 |
| H0613 | H. Leukocytes, normalized cot 5B | H. Leukocytes | | | | pCMVSport 1 |
| H0614 | H. Leukocytes, normalized cot 500 A | H. Leukocytes | | | | pCMVSport 1 |
| H0615 | Human Ovarian Cancer Reexcision | Ovarian Cancer | Ovary | | disease | Uni-ZAP XR |
| H0616 | Human Testes, Reexcision | Human Testes | Testis | | | Uni-ZAP XR |
| H0617 | Human Primary Breast Cancer Reexcision | Human Primary Breast Cancer | Breast | | disease | Uni-ZAP XR |
| H0618 | Human Adult Testes, Large Inserts, Reexcision | Human Adult Testis | Testis | | | Uni-ZAP XR |
| H0619 | Fetal Heart | Human Fetal Heart | Heart | | | Uni-ZAP XR |
| H0620 | Human Fetal Kidney; Reexcision | Human Fetal Kidney | Kidney | | | Uni-ZAP XR |
| H0622 | Human Pancreas Tumor; Reexcision | Human Pancreas Tumor | Pancreas | | disease | Uni-ZAP XR |
| H0623 | Human Umbilical Vein; Reexcision | Human Umbilical Vein Endothelial Cells | Umbilical vein | | | Uni-ZAP XR |
| H0624 | 12 Week Early Stage Human II; Reexcision | Twelve Week Old Early Stage Human | Embryo | | | Uni-ZAP XR |
| H0625 | Ku 812F Basophils Line | Ku 812F Basophils | | | | pSport1 |
| H0626 | Saos2 Cells; Untreated | Saos2 Cell Line; Untreated | | | | pSport1 |
| H0627 | Saos2 Cells; Vitamin D3 Treated | Saos2 Cell Line; Vitamin D3 Treated | | | | pSport1 |
| H0628 | Human Pre-Differentiated Adipocytes | Human Pre-Differentiated Adipocytes | | | | Uni-ZAP XR |
| H0629 | Human Leukocyte, control #2 | Human Normalized leukocyte | | | | pCMVSport 1 |
| H0630 | Human Leukocytes, normalized control #4 | Human Normalized leukocyte | | | | pCMVSport 1 |
| H0631 | Saos2, Dexamethosome Treated | Saos2 Cell Line; Dexamethosome Treated | | | | pSport1 |
| H0632 | Hepatocellular Tumor; re-excision | Hepatocellular Tumor | Liver | | | Lambda ZAP II |
| H0633 | Lung Carcinoma A549 TNFalpha activated | TNFalpha activated A549-- Lung Carcinoma | | | disease | pSport1 |
| H0634 | Human Testes Tumor, re-excision | Human Testes Tumor | Testis | | disease | Uni-ZAP XR |
| H0635 | Human Activated T-Cells, re-excision | Activated T-Cells | Blood | Cell Line | | Uni-ZAP XR |
| H0637 | Dendritic Cells From CD34 Cells | Dentritic cells from CD34 cells | | | | pSport1 |
| H0638 | CD40 activated monocyte dendridic cells | CD40 activated monocyte dendridic cells | | | | pSport1 |
| H0639 | Ficolled Human Stromal Cells, 5Fu treated | Ficolled Human Stromal Cells, 5Fu treated | | | | Other |
| H0640 | Ficolled Human Stromal Cells, Untreated | Ficolled Human Stromal Cells, Untreated | | | | Other |
| H0641 | LPS activated derived dendritic cells | LPS activated monocyte derived dendritic cells | | | | pSport1 |
| H0642 | Hep G2 Cells, lambda library | Hep G2 Cells | | | | Other |
| H0643 | Hep G2 Cells, PCR library | Hep G2 Cells | | | | Other |
| H0644 | Human Placenta (re-excision) | Human Placenta | Placenta | | | Uni-ZAP XR |

TABLE 4-continued

| Code | Description | Tissue | Organ | Cell Line | Disease | Vector |
|---|---|---|---|---|---|---|
| H0645 | Fetal Heart, re-excision | Human Fetal Heart | Heart | | | Uni-ZAP XR |
| H0646 | Lung, Cancer (4005313 A3): Invasive Poorly Differentiated Lung Adenocarcinoma, | Metastatic squamous cell lung carcinoma, poorly di | | | | pSport1 |
| H0647 | Lung, Cancer (4005163 B7): Invasive, Poorly Diff. Adenocarcinoma, Metastatic | Invasive poorly differentiated lung adenocarcinoma | | | disease | pSport1 |
| H0648 | Ovary, Cancer: (4004562 B6) Papillary Serous Cystic Neoplasm, Low Malignant Pot | Papillary Cstic neoplasm of low malignant potentia | | | disease | pSport1 |
| H0649 | Lung, Normal: (4005313 B1) | Normal Lung | | | | pSport1 |
| H0650 | B-Cells | B-Cells | | | | pCMVSprot 3.0 |
| H0651 | Ovary, Normal: (9805C040R) | Normal Ovary | | | | pSport1 |
| H0652 | Lung, Normal: (4005313 B1) | Normal Lung | | | | pSport1 |
| H0653 | Stromal Cells | Stromal Cells | | | | pSport1 |
| H0654 | Lung, Cancer: (4005313 A3) Invasive Poorly-differentiated Metastatic lung adenoc | Metastatic Squamous cell lung Carcinoma poorly dif | | | | Other |
| H0656 | B-cells (unstimulated) | B-cells (unstimulated) | | | | pSport1 |
| H0657 | B-cells (stimulated) | B-cells (stimulated) | | | | pSport1 |
| H0658 | Ovary, Cancer (9809C332): Poorly differentiated adenocarcinoma | 9809C332- Poorly differentiate | Ovary & Fallopian Tubes | | disease | pSport1 |
| H0659 | Ovary, Cancer (15395A1F): Grade II Papillary Carcinoma | Grade II Papillary Carcinoma, Ovary | Ovary | | disease | pSport1 |
| H0660 | Ovary, Cancer: (15799A1F) Poorly differentiated carcinoma | Poorly differentiated carcinoma, ovary | | | disease | pSport1 |
| H0661 | Breast, Cancer: (4004943 A5) | Breast cancer | | | disease | pSport1 |
| H0662 | Breast, Normal: (4005522B2) | Normal Breast - #4005522(B2) | Breast | | | pSport1 |
| H0663 | Breast, Cancer: (4005522 A2) | Breast Cancer - #4005522(A2) | Breast | | disease | pSport1 |
| H0664 | Breast, Cancer: (9806C012R) | Breast Cancer | Breast | | disease | pSport1 |
| H0665 | Stromal cells 3.88 | Stromal cells 3.88 | | | | pSport1 |
| H0666 | Ovary, Cancer: (4004332 A2) | Ovarian Cancer, Sample #4004332A2 | | | disease | pSport1 |
| H0667 | Stromal cells(HBM3.18) | Stromal cell(HBM 3.18) | | | | pSport1 |
| H0668 | stromal cell clone 2.5 | stromal cell clone 2.5 | | | | pSport1 |
| H0669 | Breast, Cancer: (4005385 A2) | Breast Cancer (4005385A2) | Breast | | | pSport1 |
| H0670 | Ovary, Cancer(4004650 A3): Well-Differentiated Micropapillary Serous Carcinoma | Ovarian Cancer - 4004650A3 | | | | pSport1 |
| H0671 | Breast, Cancer: (9802C02OE) | Breast Cancer- Sample # 9802C02OE | | | | pSport1 |
| H0672 | Ovary, Cancer: (4004576 A8) | Ovarian Cancer(4004576A8) | Ovary | | | pSport1 |
| H0673 | Human Prostate Cancer, Stage B2; re-excision | Human Prostate Cancer, stage B2 | Prostate | | | Uni-ZAP XR |
| H0674 | Human Prostate Cancer, Stage C; re-excission | Human Prostate Cancer, stage C | Prostate | | | Uni-ZAP XR |
| H0675 | Colon, Cancer: (9808C064R) | Colon Cancer 9808C064R | | | | pCMVSport 3.0 |
| H0676 | Colon, Cancer: (9808C064R)-total RNA | Colon Cancer 9808C064R | | | | pCMVSport 3.0 |
| H0677 | TNFR degenerate oligo screened clones from placental library | B-Cells | | | | PCRII |
| H0678 | | Placenta | Placenta | | | Other |
| H0682 | Serous Papillary Adenocarcinoma | serous papillary adenocarcinoma (9606G304SPA3B) | | | | pCMVSport 3.0 |

TABLE 4-continued

| Code | Description | Tissue | Organ | Cell Line | Disease | Vector |
|---|---|---|---|---|---|---|
| H0683 | Ovarian Serous Papillary Adenocarcinoma | Serous papillary adenocarcinoma, stage 3C (9804G01 | | | | pCMVSport 3.0 |
| H0684 | Serous Papillary Adenocarcinoma | Ovarian Cancer-9810G606 | Ovaries | | | pCMVSport 3.0 |
| H0685 | Adenocarcinoma of Ovary, Human Cell Line, # OVCAR-3 | Adenocarcinoma of Ovary, Human Cell Line, # OVCAR- | | | | pCMVSport 3.0 |
| H0686 | Adenocarcinoma of Ovary, Human Cell Line | Adenocarcinoma of Ovary, Human Cell Line, #SW-626 | | | | pCMVSport 3.0 |
| H0687 | Human normal ovary(#9610G215) | Human normal ovary(#9610G215) | Ovary | | | pCMVSport 3.0 |
| H0688 | Human Ovarian Cancer(#9807G017) | Human Ovarian cancer(#9807G017), mRNA from Maura Ru | | | | pCMVSport 3.0 |
| H0689 | Ovarian Cancer | Ovarian Cancer, #9806G019 | | | | pCMVSport 3.0 |
| H0690 | Ovarian Cancer, # 9702G001 | Ovarian Cancer, #9702G001 | | | | pCMVSport 3.0 |
| H0691 | Normal Ovary, #9710G208 | normal ovary, #9710G208 | | | | pCMVSport 3.0 |
| H0693 | Normal Prostate #ODQ3958EN | Normal Prostate Tissue # ODQ3958EN | | | | pCMVSport 3.0 |
| H0694 | Prostate gland adenocarcinoma | Prostate gland, adenocarcinoma, mod/diff, gleason | prostate gland | | | pCMVSport 3.0 |
| H0695 | mononucleocytes from patient | mononucleocytes from patient at Shady Grove Hospit | | | | pCMVSport 3.0 |
| N0003 | Human Fetal Brain | Human Fetal Brain | | | | |
| N0004 | Human Hippocampus | Human Hippocampus | | | | |
| N0006 | Human Fetal Brain | Human Fetal Brain | | | | |
| N0007 | Human Hippocampus | Human Hippocampus | | | | |
| N0009 | Human Hippocampus, prescreened | Human Hippocampus | | | | |
| N0011 | Human Brain | Human Brain | | | | |
| S0001 | Brain frontal cortex | Brain frontal cortex | Brain | | | Lambda ZAP II |
| S0002 | Monocyte activated | Monocyte-activated | blood | Cell Line | | Uni-ZAP XR |
| S0003 | Human Osteoclastoma | Osteoclastoma | bone | | disease | Uni-ZAP XR |
| S0004 | Prostate | Prostate BPH | Prostate | | | Lambda ZAP II |
| S0005 | Heart | Heart-left ventricle | Heart | | | pCDNA |
| S0006 | Neuroblastoma | Human Neural Blastoma | | | disease | pCDNA |
| S0007 | Early Stage Human Brain | Human Fetal Brain | | | | Uni-ZAP XR |
| S0008 | Osteoclastoma | Osteoclastoma | bone | | disease | Uni-ZAP XR |
| S0010 | Human Amygdala | Amygdala | | | | Uni-ZAP XR |
| S0011 | STROMAL - OSTEOCLASTOMA | Osteoclastoma | bone | | disease | Uni-ZAP XR |
| S0013 | Prostate | Prostate | prostate | | | Uni-ZAP XR |
| S0014 | Kidney Cortex | Kidney cortex | Kidney | | | Uni-ZAP XR |
| S0015 | Kidney medulla | Kidney medulla | Kidney | | | Uni-ZAP XR |
| S0016 | Kidney Pyramids | Kidney pyramids | Kidney | | | Uni-ZAP XR |
| S0020 | Seven Trans Membrane Receptor Family | 7TMD1 | | | | |
| S0021 | Whole brain | Whole brain | Brain | | | ZAP Express |
| S0022 | Human Osteoclastoma Stromal Cells - unamplified | Osteoclastoma Stromal Cells | | | | Uni-ZAP XR |
| S0023 | Human Kidney Cortex - unamplified | Human Kidney Cortex | | | | |
| S0024 | Human Kidney Medulla - unamplified | Human Kidney Medulla | | | | |
| S0025 | Human Kidney Pyramids - unamplified | Human Kidney Pyramids | | | | |
| S0026 | Stromal cell TF274 | stromal cell | Bone marrow | Cell Line | | Uni-ZAP XR |
| S0027 | Smooth muscle, serum treated | Smooth muscle | Pulmanary artery | Cell Line | | Uni-ZAP XR |
| S0028 | Smooth muscle, control | Smooth muscle | Pulmanary artery | Cell Line | | Uni-ZAP XR |
| S0029 | brain stem | Brain stem | brain | | | Uni-ZAP XR |
| S0030 | Brain pons | Brain Pons | Brain | | | Uni-ZAP XR |
| S0031 | Spinal cord | Spinal cord | spinal cord | | | Uni-ZAP XR |
| S0032 | Smooth muscle-ILb induced | Smooth muscle | Pulmanary artery | Cell Line | | Uni-ZAP XR |
| S0035 | Brain medulla oblongata | Brain medulla oblongata | Brain | | | Uni-ZAP XR |
| S0036 | Human Substantia Nigra | Human Substantia Nigra | | | | Uni-ZAP XR |

TABLE 4-continued

| Code | Description | Tissue | Organ | Cell Line | Disease | Vector |
|---|---|---|---|---|---|---|
| S0037 | Smooth muscle, IL1b induced | Smooth muscle | Pulmanary artery | Cell Line | | Uni-ZAP XR |
| S0038 | Human Whole Brain #2 - Oligo dT > 1.5 Kb | Human Whole Brain #2 | | | | ZAP Express |
| S0039 | Hypothalamus | Hypothalamus | Brain | | | Uni-ZAP XR |
| S0040 | Adipocytes | Human Adipocytes from Osteoclastoma | | | | Uni-ZAP XR |
| S0041 | Thalamus | Human Thalamus | | | | Uni-ZAP XR |
| S0042 | Testes | Human Testes | | | | ZAP Express |
| S0044 | Prostate BPH | prostate BPH | Prostate | | disease | Uni-ZAP XR |
| S0045 | Endothelial cells-control | Endothelial cell | endothelial cell-lung | Cell Line | | Uni-ZAP XR |
| S0046 | Endothelial-induced | Endothelial cell | endothelial cell-lung | Cell Line | | Uni-ZAP XR |
| S0048 | Human Hypothalamus, Alzheimer''s | Human Hypothalamus, Alzheimer''s | | | disease | Uni-ZAP XR |
| S0049 | Human Brain, Striatum | Human Brain, Striatum | | | | Uni-ZAP XR |
| S0050 | Human Frontal Cortex, Schizophrenia | Human Frontal Cortex, Schizophrenia | | | disease | Uni-ZAP XR |
| S0051 | Human Hypothalmus, Schizophrenia | Human Hypothalamus, Schizophrenia | | | disease | Uni-ZAP XR |
| S0052 | neutrophils control | human neutrophils | blood | Cell Line | | Uni-ZAP XR |
| S0053 | Neutrophils IL-1 and LPS induced | human neutrophil induced | blood | Cell Line | | Uni-ZAP XR |
| S0106 | STRIATUM DEPRESSION | | BRAIN | | disease | Uni-ZAP XR |
| S0110 | Brain Amygdala Depression | | Brain | | disease | Uni-ZAP XR |
| S0112 | Hypothalamus | | Brain | | | Uni-ZAP XR |
| S0114 | Anergic T-cell | Anergic T-cell | | Cell Line | | Uni-ZAP XR |
| S0116 | Bone marrow | Bone marrow | Bone marrow | | | Uni-ZAP XR |
| S0118 | Smooth muscle control 2 | Smooth muscle | Pulmanary artery | Cell Line | | Uni-ZAP XR |
| S0122 | Osteoclastoma-normalized A | Osteoclastoma | bone | | disease | pBluescript |
| S0124 | Smooth muscle-edited A | Smooth muscle | Pulmanary artery | Cell Line | | Uni-ZAP XR |
| S0126 | Osteoblasts | Osteoblasts | Knee | Cell Line | | Uni-ZAP XR |
| S0132 | Epithelial-TNFa and INF induced | Airway Epithelial | | | | Uni-ZAP XR |
| S0134 | Apoptotic T-cell | apoptotic cells | | Cell Line | | Uni-ZAP XR |
| S0136 | PERM TF274 | stromal cell | Bone marrow | Cell Line | | Lambda ZAP II |
| S0140 | eosinophil-IL5 induced | eosinophil | lung | Cell Line | | Uni-ZAP XR |
| S0142 | Macrophage-oxLDL | macrophage-oxidized LDL treated | blood | Cell Line | | Uni-ZAP XR |
| S0144 | Macrophage (GM-CSF treated) | Macrophage (GM-CSF treated) | | | | Uni-ZAP XR |
| S0146 | prostate-edited | prostate BPH | Prostate | | | Uni-ZAP XR |
| S0148 | Normal Prostate | Prostate | prostate | | | Uni-ZAP XR |
| S0150 | LNCAP prostate cell line | LNCAP Cell Line | Prostate | Cell Line | | Uni-ZAP XR |
| S0152 | PC3 Prostate cell line | PC3 prostate cell line | | | | Uni-ZAP XR |
| S0168 | Prostate/LNCAP, subtraction I | PC3 prostate cell line | | | | pBluescript |
| S0174 | Prostate-BPH subtracted II | Human Prostate BPH | | | | pBluescript |
| S0176 | Prostate, normal, subtraction I | Prostate | prostate | | | Uni-ZAP XR |
| S0180 | Bone Marrow Stroma, TNF & LPS ind | Bone Marrow Stroma, TNF & LPS induced | | | disease | Uni-ZAP XR |
| S0182 | Human B Cell 8866 | Human B- Cell 8866 | | | | Uni-ZAP XR |
| S0184 | 7TM Receptor enriched, lib II | PBLS, 7TM receptor enriched | | | | Other |
| S0188 | Prostate, BPH, Lib 2 | Human Prostate BPH | | | disease | pSport1 |
| S0190 | Prostate BPH, Lib 2, subtracted | Human Prostate BPH | | | | pSport1 |
| S0192 | Synovial Fibroblasts (control) | Synovial Fibroblasts | | | | pSport1 |
| S0194 | Synovial hypoxia | Synovial Fibroblasts | | | | pSport1 |
| S0196 | Synovial IL-1/TNF stimulated | Synovial Fibroblasts | | | | pSport1 |
| S0198 | 7TM-pbfd | PBLS, 7TM receptor enriched | | | | PCRII |
| S0206 | Smooth Muscle- HASTE normalized | Smooth muscle | Pulmanary artery | Cell Line | | pBluescript |

TABLE 4-continued

| Code | Description | Tissue | Organ | Cell Line | Disease | Vector |
|---|---|---|---|---|---|---|
| S0208 | Messangial cell, frac 1 | Messangial cell | | | | pSport1 |
| S0210 | Messangial cell, frac 2 | Messangial cell | | | | pSport1 |
| S0212 | Bone Marrow Stromal Cell, untreated | Bone Marrow Stromal Cell, untreated | | | | pSport1 |
| S0214 | Human Osteoclastoma, re-excision | Osteoclastoma | bone | | disease | Uni-ZAP XR |
| S0216 | Neutrophils IL-1 and LPS induced | human neutrophil induced | blood | Cell Line | | Uni-ZAP XR |
| S0218 | Apoptotic T-cell, re-excision | apoptotic cells | | Cell Line | | Uni-ZAP XR |
| S0220 | H. hypothalamus, frac A; re-excision | Hypothalamus | Brain | | | ZAP Express |
| S0222 | H. Frontal cortex, epileptic; re-excision | H. Brain, Frontal Cortex, Epileptic | Brain | | disease | Uni-ZAP XR |
| S0228 | PSMIX | PBLS, 7TM receptor enriched | | | | PCRII |
| S0242 | Synovial Fibroblasts (Il1/TNF), subt | Synovial Fibroblasts | | | | pSport1 |
| S0250 | Human Osteoblasts II | Human Osteoblasts | Femur | | disease | pCMVSport 2.0 |
| S0252 | 7TM-PIMIX | PBLS, 7TM receptor enriched | | | | PCRII |
| S0256 | 7TM-PHMIX | PBLS, 7TM receptor enriched | | | | PCRII |
| S0260 | Spinal Cord, re-excision | Spinal cord | spinal cord | | | Uni-ZAP XR |
| S0262 | PYCS | Human Antrum (PY_CS) | | | | PCRII |
| S0264 | PPMIX | PPMIX (Human Pituitary) | Pituitary | | | PCRII |
| S0268 | PRMIX | PRMIX (Human Prostate) | prostate | | | PCRII |
| S0270 | PTMIX | PTMIX (Human Thymus) | Thymus | | | PCRII |
| S0274 | PCMIX | PCMIX (Human Cerebellum) | Brain | | | PCRII |
| S0276 | Synovial hypoxia-RSF subtracted | Synovial fobroblasts (rheumatoid) | Synovial tissue | | | pSport1 |
| S0278 | H Macrophage (GM-CSF treated), re-excision | Macrophage (GM-CSF treated) | | | | Uni-ZAP XR |
| S0280 | Human Adipose Tissue, re-excision | Human Adipose Tissue | | | | Uni-ZAP XR |
| S0282 | Brain Frontal Cortex, re-excision | Brain frontal cortex | Brain | | | Lambda ZAP II |
| S0284 | 7TMCTT (Testis) | 7TMCTP (Placenta) | Testis | | | PCRII |
| S0290 | H7TMCTB (Brain) | 7TMCTB (Brain) | Kidney | | | PCRII |
| S0292 | Osteoarthritis (OA-4) | Human Osteoarthritic Cartilage | Bone | | disease | pSport1 |
| S0294 | Larynx tumor | Larynx tumor | Larynx, vocal cord | | disease | pSport1 |
| S0296 | Normal lung | Normal lung | Lung | | | pSport1 |
| S0298 | Bone marrow stroma, treated | Bone marrow stroma, treatedSB | Bone marrow | | | pSport1 |
| S0300 | Frontal lobe, dementia; re-excision | Frontal Lobe dementia/Alzheimer's | Brain | | | Uni-ZAP XR |
| S0306 | Larynx normal #10 261–273 | Larynx normal | | | | pSport1 |
| S0308 | Spleen/normal | Spleen normal | | | | pSport1 |
| S0310 | Normal trachea | Normal trachea | | | | pSport1 |
| S0312 | Human osteoarthritic; fraction II | Human osteoarthritic cartilage | | | disease | pSport1 |
| S0314 | Human osteoarthritis; fraction I | Human osteoarthritic cartilage | | | disease | pSport1 |
| S0316 | Human Normal Cartilage, Fraction I | Human Normal Cartilage | | | | pSport1 |
| S0318 | Human Normal Cartilage Fraction II | Human Normal Cartilage | | | | pSport1 |
| S0320 | Human Larynx | Larynx | Epiglottis | | | pSport1 |
| S0322 | Siebben Polyposis | Siebben Polyposis | | | | pSport1 |
| S0324 | Human Brain | Brain | Cerebellum | | | pSport1 |
| S0326 | Mammary Gland | Mammary Gland | Whole mammary gland | | | pSport1 |
| S0328 | Palate carcinoma | Palate carcinoma | Uvula | | disease | pSport1 |
| S0330 | Palate normal | Palate normal | Uvula | | | pSport1 |
| S0332 | Pharynx carcinoma | Pharynx carcinoma | Hypopharynx | | | pSport1 |
| S0334 | Human Normal Cartilage Fraction III | Human Normal Cartilage | | | | pSPort1 |
| S0336 | Human Normal Cartilage Fraction IV | Human Normal Cartilage | | | | pSport1 |
| S0338 | Human Osteoarthritic Cartilage Fraction III | Human osteoarthritic cartilage | | | disease | pSport1 |

TABLE 4-continued

| Code | Description | Tissue | Organ | Cell Line | Disease | Vector |
|---|---|---|---|---|---|---|
| S0340 | Human Osteoarthritic Cartilage Fraction IV | Human osteoarthritic cartilage | | | disease | pSport1 |
| S0342 | Adipocytes; re-excision | Human Adipocytes from Osteoclastoma | | | | Uni-ZAP XR |
| S0344 | Macrophage-oxLDL; re-excision | macrophage-oxidized LDL treated | blood | Cell Line | | Uni-ZAP XR |
| S0346 | Human Amygdala; re-excision | Amygdala | | | | Uni-ZAP XR |
| S0348 | Cheek Carcinoma | Cheek Carcinoma | | | disease | pSport1 |
| S0350 | Pharynx Carcinoma | Pharynx carcinoma | Hypopharynx | | disease | pSport1 |
| S0352 | Larynx Carcinoma | Larynx carcinoma | | | disease | pSport1 |
| S0354 | Colon Normal II | Colon Normal | Colon | | | pSport1 |
| S0356 | Colon Carcinoma | Colon Carcinoma | Colon | | disease | pSport1 |
| S0358 | Colon Normal III | Colon Normal | Colon | | | pSport1 |
| S0360 | Colon Tumor II | Colon Tumor | Colon | | disease | pSport1 |
| S0362 | Human Gastrocnemius | Gastrocnemius muscle | | | | pSport1 |
| S0364 | Human Quadriceps | Quadriceps muscle | | | | pSport1 |
| S0366 | Human Soleus | Soleus Muscle | | | | pSport1 |
| S0368 | Human Pancreatic Langerhans | Islets of Langerhans | | | | pSport1 |
| S0370 | Larynx carcinoma II | Larynx carcinoma | | | disease | pSport1 |
| S0372 | Larynx carcinoma III | Larynx carcinoma | | | disease | pSport1 |
| S0374 | Normal colon | Normal colon | | | | pSport1 |
| S0376 | Colon Tumor | Colon Tumor | | | disease | pSport1 |
| S0378 | Pancreas normal PCA4 No | Pancreas Normal PCA4 No | | | | pSport1 |
| S0380 | Pancreas Tumor PCA4 Tu | Pancreas Tumor PCA4 Tu | | | disease | pSport1 |
| S0382 | Larynx carcinoma IV | Larynx carcinoma | | | disease | pSport1 |
| S0384 | Tongue carcinoma | Tongue carcinoma | | | disease | pSport1 |
| S0386 | Human Whole Brain, re-excision | Whole brain | Brain | | | ZAP Express |
| S0388 | Human Hypothalamus, schizophrenia, re-excision | Human Hypothalamus, Schizophrenia | | | disease | Uni-ZAP XR |
| S0390 | Smooth muscle, control; re-excision | Smooth muscle | Pulmanary artery | Cell Line | | Uni-ZAP XR |
| S0392 | Salivary Gland | Salivary gland; normal | | | | pSport1 |
| S0394 | Stomach; normal | Stomach; normal | | | | pSport1 |
| S0396 | Uterus; normal | Uterus; normal | | | | pSport1 |
| S0398 | Testis; normal | Testis; normal | | | | pSport1 |
| S0400 | Brain; normal | Brain; normal | | | | pSport1 |
| S0402 | Adrenal Gland, normal | Adrenal gland; normal | | | | pSport1 |
| S0404 | Rectum normal | Rectum, normal | | | | pSport1 |
| S0406 | Rectum tumour | Rectum tumour | | | | pSport1 |
| S0408 | Colon, normal | Colon, normal | | | | pSport1 |
| S0410 | Colon, tumour | Colon, tumour | | | | pSport1 |
| S0412 | Temporal cortex-Alzheizmer; subtracted | Temporal cortex, alzheimer | | | disease | Other |
| S0414 | Hippocampus, Alzheimer Subtracted | Hippocampus, Alzheimer Subtracted | | | | Other |
| S0418 | CHME Cell Line; treated 5 hrs | CHME Cell Line; treated | | | | pCMVSport 3.0 |
| S0420 | CLIME Cell Line, untreated | CHME Cell line, untreatetd | | | | pSport1 |
| S0422 | Mo7e Cell Line GM-CSF treated (1 ng/ml) | Mo7e Cell Line GM-CSF treated (1 ng/ml) | | | | pCMVSport 3.0 |
| S0424 | TF-1 Cell Line GM-CSF Treated | TF-1 Cell Line GM-CSF Treated | | | | pSport1 |
| S0426 | Monocyte activated; re-excision | Monocyte-activated | blood | Cell Line | | Uni-ZAP XR |
| S0428 | Neutrophils control; re-excision | human neutrophils | blood | Cell Line | | Uni-ZAP XR |
| S0430 | Aryepiglottis Normal | Aryepiglottis Normal | | | | pSport1 |
| S0432 | Sinus piniformis Tumour | Sinus piniformis Tumour | | | | pSport1 |
| S0434 | Stomach Normal | Stomach Normal | | | disease | pSport1 |
| S0436 | Stomach Tumour | Stomach Tumour | | | disease | pSport1 |
| S0438 | Liver Normal Met5No | Liver Normal Met5No | | | | pSPort1 |
| S0440 | Liver Tumour Met 5 Tu | Liver Tumour | | | | pSPort1 |
| S0442 | Colon Normal | Colon Normal | | | | pSPort1 |
| S0444 | Colon Tumor | Colon Tumour | | | disease | pSPort1 |
| S0446 | Tongue Tumour | Tongue Tumour | | | | pSPort1 |
| S0448 | Larynx Normal | Larynx Normal | | | | pSPort1 |
| S0450 | Larynx Tumour | Larynx Tumour | | | | pSPort1 |
| S0452 | Thymus | Thymus | | | | pSport1 |
| S0454 | Placenta | Placenta | Placenta | | | pSport1 |
| S0456 | Tongue Normal | Tongue Normal | | | | pSport1 |

TABLE 4-continued

| Code | Description | Tissue | Organ | Cell Line | Disease | Vector |
|---|---|---|---|---|---|---|
| S0458 | Thyroid Normal (SDCA2 No) | Thyroid normal | | | | pSport1 |
| S0460 | Thyroid Tumour | Thyroid Tumour | | | | pSport1 |
| S0462 | Thyroid Thyroiditis | Thyroid Thyroiditis | | | | pSport1 |
| S0464 | Larynx Normal | Larynx Normal | | | | pSport1 |
| S0466 | Larynx Tumor | Larynx Tumor | | | disease | pSport1 |
| S0468 | Ea.hy.926 cell line | Ea.hy.926 cell line | | | | pSport1 |
| S0470 | Adenocarcinoma | PYFD | | | disease | pSport1 |
| S0472 | Lung Mesothelium | PYBT | | | | pSport1 |
| S0474 | Human blood platelets | Platelets | Blood platelets | | | Other |
| S0665 | Human Amygdala; re-excission | Amygdala | | | | Uni-ZAP XR |
| S3012 | Smooth Muscle Serum Treated, Norm | Smooth muscle | Pulmanary artery | Cell Line | | pBluescript |
| S3014 | Smooth muscle, serum induced, re-exc | Smooth muscle | Pulmanary artery | Cell Line | | pBluescript |
| S3018 | TH1 cells | TH1 cells | | | | Uni-ZAP XR |
| S6014 | H. hypothalamus, frac A | Hypothalamus | Brain | | | ZAP Express |
| S6016 | H. Frontal Cortex, Epileptic | H. Brain, Frontal Cortex, Epileptic | Brain | | disease | Uni-ZAP XR |
| S6022 | H. Adipose Tissue | Human Adipose Tissue | | | | Uni-ZAP XR |
| S6024 | Alzheimers, spongy change | Alzheimer"s/Spongy change | Brain | | disease | Uni-ZAP XR |
| S6026 | Frontal Lobe, Dementia | Frontal Lobe dementia/Alzheimer"s | Brain | | | Uni-ZAP XR |
| S6028 | Human Manic Depression Tissue | Human Manic depression tissue | Brain | | disease | Uni-ZAP XR |
| T0001 | Human Brown Fat | Brown Fat | | | | pBluescript SK- |
| T0002 | Activated T-cells | Activated T-Cell, PBL fraction | Blood | Cell Line | | pBluescript SK- |
| T0003 | Human Fetal Lung | Human Fetal Lung | | | | pBluescript SK- |
| T0004 | Human White Fat | Human White Fat | | | | pBluescript SK- |
| T0006 | Human Pineal Gland | Human Pinneal Gland | | | | pBluescript SK- |
| T0007 | Colon Epithelium | Colon Epithelium | | | | pBluescript SK- |
| T0008 | Colorectal Tumor | Colorectal Tumor | | | disease | pBluescript SK- |
| T0010 | Human Infant Brain | Human Infant Brain | | | | Other |
| T0023 | Human Pancreatic Carcinoma | Human Pancreatic Carcinoma | | | disease | pBluescript SK- |
| T0039 | HSA 172 Cells | Human HSA 172 cell line | | | | pBluescript SK- |
| T0040 | HSC172 cells | SA172 Cells | | | | pBluescript SK- |
| T0041 | Jurkat T-cell G1 phase | Jurkat T-cell | | | | pBluescript SK- |
| T0042 | Jurkat T-Cell, S phase | Jurkat T-Cell Line | | | | pBluescript SK- |
| T0048 | Human Aortic Endothelium | Human Aortic Endothilium | | | | pBluescript SK- |
| T0049 | Aorta endothelial cells + TNF-a | Aorta endothelial cells | | | | pBluescript SK- |
| T0060 | Human White Adipose | Human White Fat | | | | pBluescript SK- |
| T0067 | Human Thyroid | Human Thyroid | | | | pBluescript SK- |
| T0068 | Normal Ovary, Premenopausal | Normal Ovary, Premenopausal | | | | pBluescript SK- |
| T0069 | Human Uterus, normal | Human Uterus, normal | | | | pBluescript SK- |
| T0070 | Human Adrenal Gland | Human Adrenal Gland | | | | pBluescript SK- |
| T0071 | Human Bone Marrow | Human Bone Marrow | | | | pBluescript SK- |
| T0074 | Human Adult Retina | Human Adult Retina | | | | pBluescript SK- |
| T0078 | Human Liver, normal adult | Human Liver, normal Adult | | | | pBluescript SK- |
| T0079 | Human Kidney, normal Adult | Human Kidney, normal Adult | | | | pBluescript SK- |
| T0082 | Human Adult Retina | Human Adult Retina | | | | pBluescript SK- |
| T0086 | Human Pancreatic Carcinoma -- Screened | Human Pancreatic Carcinoma | | | disease | pBluescript SK- |
| T0087 | Alzheimer"s, exon trap, 712P | | | | disease | pAMP |
| T0090 | Liver, normal | | | | | pBluescript SK- |
| T0091 | Liver, hepatocellular carcinoma | | | | | pBluescript SK- |
| T0103 | Human colon carcinoma (HCC) cell line | | | | | pBluescript SK- |
| T0104 | HCC cell line metastisis to liver | | | | | pBluescript SK- |
| T0109 | Human (HCC) cell line liver (mouse) metastasis, remake | | | | | pBluescript SK- |
| T0110 | Human colon carcinoma (HCC) cell line, remake | | | | | pBluescript SK- |

TABLE 4-continued

| Code | Description | Tissue | Organ | Cell Line | Disease | Vector |
|---|---|---|---|---|---|---|
| T0112 | Human (Caco-2) cell line, adenocarcinoma, colon | | | | | pBluescript SK- |
| T0114 | Human (Caco-2) cell line, adenocarcinoma, colon, remake | | | | | pBluescript SK- |
| T0115 | Human Colon Carcinoma (HCC) cell line | | | | | pBluescript SK- |
| L0002 | Atrium cDNA library Human heart | | | | | |
| L0004 | CLONTECH ™ HL 1065a | | | | | |
| L0005 | CLONTECH ™ human aorta polyA + mRNA (#6572) | | | | | |
| L0009 | EST from 8p21.3-p22 | | | | | |
| L0012 | HDMEC cDNA library | | | | | |
| L0015 | Human | | | | | |
| L0017 | Human (J. Swensen) | | | | | |
| L0018 | Human (M. Lovett) | | | | | |
| L0021 | Human adult (K. Okubo) | | | | | |
| L0022 | Human adult lung 3" directed MboI cDNA | | | | | |
| L0023 | human adult testis | | | | | |
| L0024 | Human brain A R Sanders | | | | | |
| L0025 | Human brain striatum | | | | | |
| L0032 | Human chromosome 12p cDNAs | | | | | |
| L0033 | Human chromosome 13q14 cDNA | | | | | |
| L0034 | Human chromosome 14 | | | | | |
| L0040 | Human colon mucosa | | | | | |
| L0041 | Human epidermal keratinocyte | | | | | |
| L0045 | Human keratinocyte differential display (B. Lin) | | | | | |
| L0052 | Human normalized K562-cDNA | | | | | |
| L0053 | Human pancreatic tumor | | | | | |
| L0055 | Human promyelocyte | | | | | |
| L0060 | Human thymus NSTH II | | | | | |
| L0065 | Liver HepG2 cell line. | | | | | |
| L0070 | Selected chromosome 21 cDNA library | | | | | |
| L0096 | Subtracted human retina | | | | | |
| L0097 | Subtracted human retinal pigment epithelium (RPE) | | | | | |
| L0103 | DKFZphamyl | amygdala | | | | |
| L0105 | Human aorta polyA + (T Fujiwara) | aorta | | | | |
| L0109 | Human brain cDNA | brain | | | | |
| L0114 | Human fetal brain (R. L. Margolis) | brain | | | | |
| L0117 | Human fetal brain cDNA (T. M. Gress) | brain | | | | |
| L0121 | Stratagene catalog #936206 | brain | | | | |
| L0130 | Human hippocampus, Stratagene catalog #936205 | hippocampus | | | | |
| L0136 | Human neuroepithelium (N. Jiang) | neuroepithelium | | | | |
| L0138 | Human normal gingiva | normal gingiva | | | | |
| L0140 | Human pancreatic cancer (C Wallrapp) | pancreatic cancer | | | | |
| L0142 | Human placenta cDNA (T Fujiwara) | placenta | | | | |
| L0143 | Human placenta polyA + (TFujiwara) | placenta | | | | |
| L0145 | Human retina (D. Swanson) | retina | | | | |
| L0146 | Human fovea cDNA | retinal fovea | | | | |
| L0149 | DKFZphsnu1 | subthalamic nucleus | | | | |
| L0151 | Human testis (C. De Smet) | testis | | | | |

TABLE 4-continued

| Code | Description | Tissue | Organ | Cell Line | Disease | Vector |
|---|---|---|---|---|---|---|
| L0157 | Human fetal brain (T Fujiwara) | | brain | | | |
| L0158 | Human fetal brain QBogin | | brain | | | |
| L0163 | Human heart cDNA (Y Nakamura) | | heart | | | |
| L0171 | Human lung adenocarcinoma A549 | lung adenocarcinoma | | A549 | | |
| L0175 | Human retina cell line ARPE-19 | retina | | ARPE-19 | | |
| L0177 | Human newborn melanocytes (T. Vogt) | | | Clonetics Corp. (San Diego, CA) strain #68 and 2486 | | |
| L0182 | Human HeLa (Y. Wang) | | | HeLa | | |
| L0183 | Human HeLa cells (M. Lovett) | | | HeLa | | |
| L0185 | Human immortalized fibroblasts (H. L. Ozer) | | | HS74 and its SV40-transformed sublines | | |
| L0187 | Human fibrosarcoma cell line HT1080 | fibrosarcoma | | HT1080 | | |
| L0194 | Human pancreatic cancer cell line Patu 8988t | pancreatic cancer | | Patu 8988t | | |
| L0295 | Human liver EST (Y. L. Yu) | | liver | | | |
| L0307 | Human C3-A11N | | | C3-A11N; clonally related variant of OCI LY8-C3P | | |
| L0309 | Human E8CASS | breast adenocarcinoma | | E8CASS; variant of MCF7 | | |
| L0351 | Infant brain, Bento Soares | | | | | BA, M13-derived |
| L0352 | Nonnalized infant brain, Bento Soares | | | | | BA, M13-derived |
| L0354 | JG, Human foetal Kidney tissue | | | | | Bluescript |
| L0355 | P, Human foetal Brain Whole tissue | | | | | Bluescript |
| L0356 | S, Human foetal Adrenals tissue | | | | | Bluescript |
| L0357 | V, Human Placenta tissue | | | | | Bluescript KS II+ |
| L0361 | Stratagene ovary (#937217) | | ovary | | | Bluescript SK |
| L0362 | Stratagene ovarian cancer (#937219) | | | | | Bluescript SK- |
| L0363 | NCI_CGAP_GC2 | germ cell tumor | | | | Bluescript SK- |
| L0364 | NCI_CGAP_GC5 | germ cell tumor | | | | Bluescript SK- |
| L0365 | NCI_CGAP_Phe1 | pheochromocytoma | | | | Bluescript SK- |
| L0366 | Stratagene schizo brain S11 | schizophrenic brain S-11 frontal lobe | | | | Bluescript SK- |
| L0367 | NCI_CGAP_Sch1 | Schwannoma tumor | | | | Bluescript SK- |
| L0368 | NCI_CGAP_SS1 | synovial sarcoma | | | | Bluescript SK- |
| L0369 | NCI_CGAP_AA1 | adrenal adenoma | adrenal gland | | | Bluescript SK- |
| L0370 | Johnston frontal cortex | pooled frontal lobe | brain | | | Bluescript SK- |
| L0371 | NCI_CGAP_Br3 | breast tumor | breast | | | Bluescript SK- |
| L0372 | NCI_CGAP_Col2 | colon tumor | colon | | | Bluescript SK- |
| L0373 | NCI_CGAP_Co11 | tumor | colon | | | Bluescript SK- |
| L0374 | NCI_CGAP_Co2 | tumor | colon | | | Bluescript SK- |
| L0375 | NCI_CGAP_Kid6 | kidney tumor | kidney | | | Bluescript SK- |
| L0376 | NCI_CGAP_Lar1 | larynx | larynx | | | Bluescript SK- |
| L0377 | NCI_CGAP_HN2 | squamous cell carcinoma from vocal cord | larynx | | | Bluescript SK- |
| L0378 | NCI_CGAP_Lu1 | lung tumor | lung | | | |
| L0379 | NCI_CGAP_Lym3 | lymphoma | lymph node | | | Bluescript SK- |
| L0381 | NCI_CGAP_HN4 | squamous cell carcinoma | pharynx | | | Bluescript SK- |
| L0382 | NCI_CGAP_Pr25 | epithelium (cell line) | prostate | | | Bluescript SK- |
| L0383 | NCI_CGAP_Pr24 | invasive tumor (cell line) | prostate | | | Bluescript SK- |
| L0384 | NCI_CGAP_Pr23 | prostate tumor | prostate | | | Bluescript SK- |
| L0385 | NCI_CGAP_Gas1 | gastric tumor | stomach | | | Bluescript SK- |

TABLE 4-continued

| Code | Description | Tissue | Organ | Cell Line | Disease | Vector |
|---|---|---|---|---|---|---|
| L0386 | NCI_CGAP_HN3 | squamous cell carcinoma from base of tongue | tongue | | | Bluescript SK- |
| L0387 | NCI_CGAP_GCB0 | germinal center B-cells | tonsil | | | Bluescript SK- |
| L0388 | NCI_CGAP_HN6 | normal gingiva (cell line from immortalized kerati | | | | Bluescript SK- |
| L0389 | NCI_CGAP_HN5 | normal gingiva (cell line from primary keratinocyt | | | | Bluescript SK- |
| L0393 | B, Human Liver tissue | | | | | gt11 |
| L0394 | H, Human adult Brain Cortex tissue | | | | | gt11 |
| L0404 | b4HB3MA Cot109 + 103 + 85-Bio | | | | | Lafmid BA |
| L0411 | 1-NIB | | | | | Lafmid BA |
| L0414 | b4HB3MA | | | | | Lafmid BA |
| L0415 | b4HB3MA Cot8-HAP-Ft | | | | | Lafmid BA |
| L0416 | b4HB3MA-Cot0.38-HAP-B | | | | | Lafmid BA |
| L0417 | b4HB3MA-Cot0.38-HAP-Ft-6 | | | | | Lafmid BA |
| L0418 | b4HB3MA-Cot109 + 10-Bio | | | | | Lafmid BA |
| L0419 | b4HB3MA-Cot109 + 103 + 85-Bio | | | | | Lafmid BA |
| L0424 | b4HB3MA-Cot14.5 | | | | | Lafmid BA |
| L0426 | b4HB3MA-Cot51.5-HAP-Ft | | | | | Lafmid BA |
| L0427 | b4HB3MA-FT20%-Biotin | | | | | Lafmid BA |
| L0428 | Cot1374Ft-4HB3MA | | | | | Lafmid BA |
| L0430 | Cot250Ft-b4HB3MA | | | | | Lafmid BA |
| L0433 | HWM42YA | | | | | Lafmid BA |
| L0434 | Infant brain library of Dr. M. Soares | | | | | lafmid BA |
| L0435 | Infant brain, LLNL array of Dr. M. Soares 1NIB | | | | | lafmid BA |
| L0437 | N-b4HB3MA-Cot109 | | | | | Lafmid BA |
| L0438 | normalized infant brain cDNA | total brain | brain | | | lafmid BA |
| L0439 | Soares infant brain 1NIB | | whole brain | | | Lafmid BA |
| L0441 | 2HB3MK | | | | | Lafmid BK |
| L0442 | 4HB3MK | | | | | Lafmid BK |
| L0443 | b4HB3MK | | | | | Lafmid BK |
| L0446 | N4HB3MK | | | | | Lafmid BK |
| L0447 | NHB3MK | | | | | Lafmid BK |
| L0448 | 3HFLSK20 | | | | | Lafmid K |
| L0451 | N3HFLSK20 | | | | | Lafmid K |
| L0453 | BATM1 | | | | | lambda gt10 |
| L0454 | CLONTECH ™ adult human fat cell library HL1108A | | | | | lambda gt10 |
| L0455 | Human retina cDNA randomly primed sublibrary | retina | eye | | | lambda gt10 |
| L0456 | Human retina cDNA Tsp509I-cleaved sublibrary | retina | eye | | | lambda gt10 |
| L0457 | multi-tissue normalized short-fragment | multi-tissue | pooled | | | lambda gt10 |
| L0459 | Adult heart, CLONTECH ™ | | | | | Lambda gt11 |
| L0460 | Adult heart, Lambda gt11 | | | | | Lambda gt11 |
| L0462 | WATM1 | | | | | lambda gt11 |
| L0463 | fetal brain cDNA | brain | brain | | | lambda gt11 |
| L0465 | TEST1, Human adult Testis tissue | | | | | lambda nm1149 |
| L0467 | Fetal heart, Lambda ZAP Express | | | | | Lambda ZAP |
| L0468 | HE6W | | | | | lambda zap |
| L0470 | BL29 Burkitt''s lymphoma, Pascalis Sideras | | | | | lambda ZAP 2 |
| L0471 | Human fetal heart, Lambda ZAP Express | | | | | Lambda ZAP Express |
| L0475 | KG1-a Lambda Zap Express cDNA library | | | KG1-a | | Lambda Zap Express (Stratagene) |
| L0476 | Fetal brain, Stratagene | | | | | Lambda ZAP II |

TABLE 4-continued

| Code | Description | Tissue | Organ | Cell Line | Disease | Vector |
|---|---|---|---|---|---|---|
| L0477 | HPLA CCLee | placenta | | | | Lambda ZAP II |
| L0480 | Stratagene cat#937212 (1992) | | | | | Lambda ZAP, pBluescript SK(−) |
| L0481 | CD34 + DIRECTIONAL | | | | | Lambda ZAPII |
| L0482 | HT29M6 | | | | | Lambda ZAPII |
| L0483 | Human pancreatic islet | | | | | Lambda ZAPII |
| L0485 | STRATAGENE Human skeletal muscle cDNA library, cat. #936215. | skeletal muscle | leg muscle | | | Lambda ZAPII |
| L0486 | Human promyelocytic HL60 cell line | | | promyelocytic HL60 cell line | | lambda ZAPII |
| L0492 | (S. Herblot) Human Genomic | | | | | pAMP |
| L0493 | NCI_CGAP__Ov26 | papillary serous carcinoma | ovary | | | pAMP1 |
| L0497 | NCI_CGAP__HSC4 | CD34+, CD38− from normal bone marrow donor | bone marrow | | | pAMP1 |
| L0498 | NCI_CGAP__HSC3 | CD34+, T negative, patient with chronic myelogenou | bone marrow | | | pAMP1 |
| L0499 | NCI_CGAP__HSC2 | stem cell 34+/38+ | bone marrow | | | pAMP1 |
| L0500 | NCI_CGAP__Brn20 | oligodendroglioma | brain | | | pAMP1 |
| L0501 | NCI_CGAP__Brn21 | oligodendroglioma | brain | | | pAMP1 |
| L0502 | NCI_CGAP__Br15 | adenocarcinoma | breast | | | pAMP1 |
| L0503 | NCI_CGAP__Br17 | adenocarcinoma | breast | | | pAMP1 |
| L0504 | NCI_CGAP__Br13 | breast carcinoma in situ | breast | | | pAMP1 |
| L0505 | NCI_CGAP__Br12 | invasive carcinoma | breast | | | pAMP1 |
| L0506 | NCI_CGAP__Br16 | lobullar carcinoma in situ | breast | | | pAMP1 |
| L0507 | NCI_CGAP__Br14 | normal epithelium | breast | | | pAMP1 |
| L0508 | NCI_CGAP__Lu25 | bronchioalveolar carcinoma | lung | | | pAMP1 |
| L0509 | NCI_CGAP__Lu26 | invasive adenocarcinoma | lung | | | pAMP1 |
| L0510 | NCI_CGAP__Ov33 | borderline ovarian carcinoma | ovary | | | pAMP1 |
| L0511 | NCI_CGAP__Ov34 | borderline ovarian carcinoma | ovary | | | pAMP1 |
| L0512 | NCI_CGAP__Ov36 | borderline ovarian carcinoma | ovary | | | pAMP1 |
| L0513 | NCI_CGAP__Ov37 | early stage papillary serous carcinoma | ovary | | | pAMP1 |
| L0514 | NCI_CGAP__Ov31 | papillary serous carcinoma | ovary | | | pAMP1 |
| L0515 | NCI_CGAP__Ov32 | papillary serous carcinoma | ovary | | | pAMP1 |
| L0517 | NCI_CGAP__Pr1 | | | | | pAMP10 |
| L0518 | NCI_CGAP__Pr2 | | | | | pAMP10 |
| L0519 | NCI_CGAP__Pr3 | | | | | pAMP10 |
| L0520 | NCI_CGAP__Alv1 | alveolar rhabdomyosarcoma | | | | pAMP10 |
| L0521 | NCI_CGAP__Ew1 | Ewing"s sarcoma | | | | pAMP10 |
| L0522 | NCI_CGAP__Kid1 | kidney | | | | pAMP10 |
| L0523 | NCI_CGAP__Lip2 | liposarcoma | | | | pAMP10 |
| L0524 | NCI_CGAP__Li1 | liver | | | | pAMP10 |
| L0525 | NCI_CGAP__Li2 | liver | | | | pAMP10 |
| L0526 | NCI_CGAP__Pr12 | metastatic prostate bone lesion | | | | pAMP10 |
| L0527 | NCI_CGAP__Ov2 | ovary | | | | pAMP10 |
| L0528 | NCI_CGAP__Pr5 | prostate | | | | pAMP10 |
| L0529 | NCI_CGAP__Pr6 | prostate | | | | pAMP10 |
| L0530 | NCI_CGAP__Pr8 | prostate | | | | pAMP10 |
| L0531 | NCI_CGAP__Pr20 | prostate metastasis, liver | | | | pAMP10 |
| L0532 | NCI_CGAP__Thy1 | thyroid | | | | pAMP10 |
| L0533 | NCI_CGAP__HSC1 | stem cells | bone marrow | | | pAMP10 |
| L0534 | Chromosome 7 Fetal Brain cDNA Library | brain | brain | | | pAMP10 |
| L0535 | NCI_CGAP__Br5 | infiltrating ductal carcinoma | breast | | | pAMP10 |
| L0536 | NCI_CGAP__Br4 | normal ductal tissue | breast | | | pAMP10 |
| L0538 | NCI_CGAP__Ov5 | normal surface epithelium | ovary | | | pAMP10 |
| L0539 | Chromosome 7 Placental cDNA Library | | placenta | | | pAMP10 |
| L0540 | NCI_CGAP__Pr10 | invasive prostate tumor | prostate | | | pAMP10 |
| L0541 | NCI_CGAP__Pr7 | low-grade prostatic neoplasia | prostate | | | pAMP10 |
| L0542 | NCI_CGAP__Pr11 | normal prostatic epithelial cells | prostate | | | pAMP10 |
| L0543 | NCI_CGAP__Pr9 | normal prostatic epithelial cells | prostate | | | pAMP10 |

TABLE 4-continued

| Code | Description | Tissue | Organ | Cell Line | Disease | Vector |
|---|---|---|---|---|---|---|
| L0544 | NCI_CGAP_Pr4 | prostatic intraepithelial neoplasia - high grade | prostate | | | pAMP10 |
| L0545 | NCI_CGAP_Pr4.1 | prostatic intraepithelial neoplasia - high grade | prostate | | | pAMP10 |
| L0546 | NCI_CGAP_Pr18 | stroma | prostate | | | pAMP10 |
| L0547 | NCI_CGAP_Pr16 | tumor | prostate | | | pAMP10 |
| L0549 | NCI_CGAP_HN10 | carcinoma in situ from retromolar trigone | | | | pAMP10 |
| L0550 | NCI_CGAP_HN9 | normal squamous epithelium from retromolar trigone | | | | pAMO10 |
| L0551 | NCI_CGAP_HN7 | normal squamous epithelium, floor of mouth | | | | pAMP10 |
| L0552 | NCI_CGAP_HN8 | well-differentiated invasive carcinoma, floor of m | | | | pAMP10 |
| L0553 | NCI_CGAP_Co22 | colonic adenocarcinoma | colon | | | pAMP10 |
| L0554 | NCI_CGAP_Li8 | | liver | | | pAMP10 |
| L0555 | NCI_CGAP_Lu34 | large cell carcinoma | lung | | | pAMP10 |
| L0557 | NCI_CGAP_Lu21 | small cell carcinoma | lung | | | pAMP10 |
| L0558 | NCI_CGAP_0v40 | endometrioid ovarian metastasis | ovary | | | pAMP10 |
| L0559 | NCI_CGAP_Ov39 | papillary serous ovarian metastasis | ovary | | | pAMP10 |
| L0560 | NCI_CGAP_HN12 | moderate to poorly differentiated invasive carcino | tongue | | | pAMP10 |
| L0561 | NCI_CGAP_HN11 | normal squamous epithelium | tongue | | | pAMP10 |
| L0562 | Chromosome 7 HeLa cDNA Library | | | HeLa cell line; ATCC | | pAMP10 |
| L0563 | Human Bone Marrow Stromal Fibroblast | bone marrow | | | | pBluescript |
| L0564 | Jia bone marrow stroma | bone marrow stroma | | | | pBluescript |
| L0565 | Normal Human Trabecular Bone Cells | Bone | Hip | | | pBluescript |
| L0581 | Stratagene liver (#937224) | | liver | | | pBluescript SK |
| L0583 | Stratagene cDNA library Human fibroblast, cat#937212 | | | | | pBluescript SK(+) |
| L0584 | Stratagene cDNA library Human heart, cat#936208 | | | | | pBluescript SK(+) |
| L0586 | HTCDL1 | | | | | pBluescript SK(31) |
| L0587 | Stratagene colon HT29 (#937221) | | | | | pBluescript SK– |
| L0588 | Stratagene endothelial cell 937223 | | | | | pBluescript SK– |
| L0589 | Stratagene fetal retina 937202 | | | | | pBluescript SK– |
| L0590 | Stratagene fibroblast (#937212) | | | | | pBluescript SK– |
| L0591 | Stratagene HeLa cell s3 937216 | | | | | pBluescript SK– |
| L0592 | Stratagene hNT neuron (#937233) | | | | | pBluescript SK– |
| L0593 | Stratagene neuroepithelium (#937231) | | | | | pBluescript SK– |
| L0594 | Stratagene neuroepithelium NT2RAMI 937234 | | | | | pBluescript SK– |
| L0595 | Stratagene NT2 neuronal precursor 937230 | neuroepithelial cells | brain | | | pBluescript SK– |
| L0596 | Stratagene colon (#937204) | | colon | | | pBluescript SK– |
| L0597 | Stratagene corneal stroma (#937222) | | cornea | | | pBluescript SK– |
| L0598 | Morton Fetal Cochlea | cochlea | ear | | | pBluescript SK– |
| L0599 | Stratagene lung (#937210) | | lung | | | pBluescript SK– |
| L0600 | Weizmann Olfactory Epithelium | olfactory epithelium | nose | | | pBluescript SK– |
| L0601 | Stratagene pancreas (#937208) | | pancreas | | | pBluescript SK– |
| L0602 | Pancreatic Islet | pancreatic islet | pancreas | | | pBluescript SK– |

TABLE 4-continued

| Code | Description | Tissue | Organ | Cell Line | Disease | Vector |
|---|---|---|---|---|---|---|
| L0603 | Stratagene placenta (#937225) | | placenta | | | pBluescript SK– |
| L0604 | Stratagene muscle 937209 | muscle | skeletal muscle | | | pBluescript SK– |
| L0605 | Stratagene fetal spleen (#937205) | fetal spleen | spleen | | | pBluescript SK– |
| L0606 | NCI_CGAP_Lym5 | follicular lymphoma | lymph node | | | pBluescript SK– |
| L0607 | NCI_CGAP_Lym6 | mantle cell lymphoma | lymph node | | | pBluescript SK– |
| L0608 | Stratagene lung carcinoma 937218 | lung carcinoma | lung | NCI-H69 | | pBluescript SK– |
| L0609 | Schiller astrocytoma | astrocytoma | brain | | | pBluescript SK– (Stratagene) |
| L0610 | Schiller glioblastoma multiforme | glioblastoma multiforme | brain | | | pBluescript SK– (Stratagene) |
| L0611 | Schiller meningioma | meningioma | brain | | | pBluescript SK– (Stratagene) |
| L0612 | Schiller oligodendroglioma | oligodendroglioma | brain | | | pBluescript SK– (Stratagene) |
| L0615 | 22 week old human fetal liver cDNA library | | | | | pBluescriptII SK(–) |
| L0616 | Chromosome 21 exon | | | | | pBluescriptIIKS+ |
| L0617 | Chromosome 22 exon | | | | | pBluescriptIIKS+ |
| L0618 | Chromosome 9 exon | | | | | pBluescriptIIKS+ |
| L0619 | Chromosome 9 exon II | | | | | pBluescriptIIKS+ |
| L0622 | HM1 | | | | | pcDNAII (Invitrogen) |
| L0623 | HM3 | pectoral muscle (after mastectomy) | | | | pcDNAII (Invitrogen) |
| L0625 | NCI_CGAP_AR1 | bulk alveolar tumor | | | | pCMV-SPORT2 |
| L0626 | NCI_CGAP_GC1 | bulk germ cell seminoma | | | | pCMV-SPORT2 |
| L0627 | NCI_CGAP_Co1 | bulk tumor | colon | | | pCMV-SPORT2 |
| L0628 | NCI_CGAP_Ov1 | ovary bulk tumor | ovary | | | pCMV-SPORT2 |
| L0629 | NCI_CGAP_Mel3 | metastatic melanoma to bowel | bowel (skin primary) | | | pCMV-SPORT4 |
| L0630 | NCI_CGAP_CNS1 | substantia nigra | brain | | | pCMV-SPORT4 |
| L0631 | NCI_CGAP_Br7 | | breast | | | pCMV-SPORT4 |
| L0632 | NCI_CGAP_Li5 | hepatic adenoma | liver | | | pCMV-SPORT4 |
| L0633 | NCI_CGAP_Lu6 | small cell carcinoma | lung | | | pCMV-SPORT4 |
| L0634 | NCI_CGAP_Ov8 | serous adenocarcinoma | ovary | | | pCMV-SPORT4 |
| L0635 | NCI_CGAP_PNS1 | dorsal root ganglion | peripheral nervous system | | | pCMV-SPORT4 |
| L0636 | NCI_CGAP_Pit1 | four pooled pituitary adenomas | brain | | | pCMV-SPORT6 |
| L0637 | NCI_CGAP_Brn53 | three pooled meningiomas | brain | | | pCMV-SPORT6 |
| L0638 | NCI_CGAP_Brn35 | tumor, 5 pooled (see description) | brain | | | pCMV-SPORT6 |
| L0639 | NCI_CGAP_Brn52 | tumor, 5 pooled (see description) | brain | | | pCMV-SPORT6 |
| L0640 | NCI_CGAP_Br18 | four pooled high-grade tumors, including two prima | breast | | | pCMV-SPORT6 |
| L0641 | NCI_CGAP_Co17 | juvenile granulosa tumor | colon | | | pCMV-SPORT6 |
| L0642 | NCI_CGAP_Co18 | moderately differentiated adenocarcinoma | colon | | | pCMV-SPORT6 |
| L0643 | NCI_CGAP_Co19 | moderately differentiated adenocarcinoma | colon | | | pCMV-SPORT6 |
| L0644 | NCI_CGAP_Co20 | moderately differentiated adenocarcinoma | colon | | | pCMV-SPORT6 |
| L0645 | NCI_CGAP_Co21 | moderately differentiated adenocarcinoma | colon | | | pCMV-SPORT6 |
| L0646 | NCI_CGAP_Co14 | moderately-differentiated adenocarcinoma | colon | | | pCMV-SPORT6 |
| L0647 | NCI_CGAP_Sar4 | five pooled sarcomas, including myxoid liposarcoma | connective tissue | | | pCMV-SPORT6 |
| L0648 | NCI_CGAP_Eso2 | squamous cell carcinoma | esophagus | | | pCMV-SPORT6 |
| L0649 | NCI_CGAP_GU1 | 2 pooled high-grade transitional cell tumors | genitourinary tract | | | pCMV-SPORT6 |
| L0650 | NCI_CGAP_Kid13 | 2 pooled Wilms" tumors, one primary and one metast | kidney | | | pCMV-SPORT6 |
| L0651 | NCI_CGAP_Kid8 | renal cell tumor | kidney | | | pCMV-SPORT6 |
| L0652 | NCI_CGAP_Lu27 | four pooled poorly-differentiated adenocarcinomas | lung | | | pCMV-SPORT6 |

TABLE 4-continued

| Code | Description | Tissue | Organ | Cell Line | Disease | Vector |
|---|---|---|---|---|---|---|
| L0653 | NCI_CGAP_Lu28 | two pooled squamous cell carcinomas | lung | | | pCMV-SPORT6 |
| L0654 | NCI_CGAP_Lu31 | | lung, cell line | | | pCMV-SPORT6 |
| L0655 | NCI_CGAP_Lym12 | lymphoma, follicular mixed small and large cell | lymph node | | | pCMV-SPORT6 |
| L0656 | NCI_CGAP_Ov38 | normal epithelium | ovary | | | pCMV-SPORT6 |
| L0657 | NCI_CGAP_Ov23 | tumor, 5 pooled (see description) | ovary | | | pCMV-SPORT6 |
| L0658 | NCI_CGAP_Ov35 | tumor, 5 pooled (see description) | ovary | | | pCMV-SPORT6 |
| L0659 | NCI_CGAP_Pan1 | adenocarcinoma | pancreas | | | pCMV-SPORT6 |
| L0661 | NCI_CGAP_Mel15 | malignant melanoma, metastatic to lymph node | skin | | | pCMV-SPORT6 |
| L0662 | NCI_CGAP_Gas4 | poorly differentiated adenocarcinoma with signet r | stomach | | | pCMV-SPORT6 |
| L0663 | NCI_CGAP_Ut2 | moderately-differentiated endometrial adenocarcino | uterus | | | pCMV-SPORT6 |
| L0664 | NCI_CGAP_Ut3 | poorly-differentiated endometrial adenocarcinoma, | uterus | | | pCMV-SPORT6 |
| L0665 | NCI_CGAP_Ut4 | serous papillary carcinoma, high grade, 2 pooled t | uterus | | | pCMV-SPORT6 |
| L0666 | NCI_CGAP_Ut1 | well-differentiated endometrial adenocarcinoma, 7 | uterus | | | pCMV-SPORT6 |
| L0667 | NCI_CGAP_CML1 | myeloid cells, 18 pooled CML cases, BCR/ABL rearra | whole blood | | | pCMV-SPORT6 |
| L0669 | Human MCF7 cDNA subtracted with MDA-MB-231 cDNA | breast adenocarcinoma | breast | MCF7 | | pCR II [Invitrogen] |
| L0681 | Stanley Frontal SN individual | frontal lobe (see description) | brain | | | pCR2.1 (Invitrogen) |
| L0682 | Stanley Frontal NB pool 2 | frontal lobe (see description) | brain | | | pCR2.1-TOPO (Invitrogen) |
| L0683 | Stanley Frontal NS pool 2 | frontal lobe (see description) | brain | | | pCR2.1-TOPO (Invitrogen) |
| L0684 | Stanley Frontal SB pool 1 | frontal lobe (see description) | brain | | | pCR2.1-TOPO (Invitrogen) |
| L0686 | Stanley Frontal SN pool 2 | frontal lobe (see description) | brain | | | pCR2.1-TOPO (Invitrogen) |
| L0690 | Testis, Subtracted | | | | | pCRII |
| L0695 | Human Glialblastoma Cell | | Brain | BT-325 | | PCRII, Invitrogen |
| L0697 | Testis 1 | | | | | PGEM 5zf(+) |
| L0698 | Testis 2 | | | | | PGEM 5zf(+) |
| L0708 | NIH_MGC_17 | rhabdomyosarcoma | muscle | | | pOTB7 |
| L0709 | NIH_MGC_21 | choriocarcinoma | placenta | | | pOTB7 |
| L0710 | NIH_MGC_7 | small cell carcinoma | lung | MGC3 | | pOTB7 |
| L0716 | PMA-induced HL60 cell subtraction library | | | PMA-induced HL60 human leukemic cell line | | pSPORT1 |
| L0717 | Gessler Wilms tumor | | | | | pSPORT1 |
| L0718 | Testis 5 | | | | | pSPORT1 |
| L0720 | PN001-Normal Human Prostate | | prostate | | | pSport1 |
| L0731 | Soares_pregnant_uterus_NbHPU | | uterus | | | pT7T3-PAc |
| L0738 | Human colorectal cancer | | | | | pT7T3D |
| L0740 | Soares melanocyte 2NbHM | melanocyte | | | | pT7T3D (Pharmacia) with a modified polylinker |
| L0741 | Soares adult brain N2b4HB55Y | | brain | | | pT7T3D (Pharmacia) with a modified polylinker |
| L0742 | Soares adult brain N2b5HB55Y | | brain | | | PT7T3D (Pharmacia) with a modified polylinker |

TABLE 4-continued

| Code | Description | Tissue | Organ | Cell Line | Disease | Vector |
|---|---|---|---|---|---|---|
| L0743 | Soares breast 2NbHBst | | breast | | | pT7T3D (Pharmacia) with a modified polylinker |
| L0744 | Soares breast 3NbHBst | | breast | | | pT7T3D (Pharmacia) with a modified polylinker |
| L0745 | Soares retina N2b4HR | retina | eye | | | pT7T3D (Pharmacia) with a modified polylinker |
| L0746 | Soares retina N2b5HR | retina | eye | | | pT7T3D (Pharmacia) with a modified polylinker |
| L0747 | Soares__fetal__heart__NbHH19W | | heart | | | pT7T3D (Pharmacia) with a modified polylinker |
| L0748 | Soares fetal liver spleen 1NFLS | | Liver and Spleen | | | pT7T3D (Pharmacia) with a modified polylinker |
| L0749 | Soares__fetal__liver__spleen__1NFLS__S1 | | Liver and Spleen | | | pT7T3D (Pharmacia) with a modified polylinker |
| L0750 | Soares__fetal__lung__NbHL19W | | lung | | | pT7T3D (Pharmacia) with a modified polylinker |
| L0751 | Soares ovary tumor NbHOT | ovarian tumor | ovary | | | pT7T3D (Pharmacia) with a modified polylinker |
| L0752 | Soares__parathyroid__tumor__NbHPA | parathyroid tumor | parathyroid gland | | | pT7T3D (Pharmacia) with a modified polylinker |
| L0753 | Soares__pineal__gland__N3HPG | | pineal gland | | | pT7T3D (Pharmacia) with a modified polylinker |
| L0754 | Soares placenta Nb2HP | | placenta | | | pT7T3D (Pharmacia) with a modified polylinker |
| L0755 | Soares__placenta__8 to 9 weeks__2NbHP 8 to 9 W | | placenta | | | pT7T3D (Pharmacia) with a modified polylinker |
| L0756 | Soares__multiple__sclerosis__2NbHMSP | multiple sclerosis lesions | | | | pT7T3D (Pharmacia) with a modified polylinker V__TYPE |
| L0757 | Soares__senescent__fibroblasts__NbHSF | senescent fibroblast | | | | pT7T3D (Pharmacia) with a modified polylinker V__TYPE |
| L0758 | Soares__testis__NHT | | | | | pT7T3D-Pac (Pharmacia) with a modified polylinker |
| L0759 | Soares__total__fetus__Nb2HF8__9 w | | | | | pT7T3D-Pac (Pharmacia) with a modified polylinker |
| L0760 | Barstead aorta HPLRB3 | aorta | | | | pT7T3D-Pac (Pharmacia) with a modified polylinker |

TABLE 4-continued

| Code | Description | Tissue | Organ | Cell Line | Disease | Vector |
|---|---|---|---|---|---|---|
| L0761 | NCI_CGAP_CLL1 | B-cell, chronic lymphotic leukemia | | | | pT7T3D-Pac (Pharmacia) with a modified polylinker |
| L0762 | NCI_CGAP_Br1.1 | breast | | | | pT7T3D-Pac (Pharmacia) with a modified polylinker |
| L0763 | NCI_CGAP_Br2 | breast | | | | pT7T3D-Pac (Pharmacia) with a modified polylinker |
| L0764 | NCI_CGAP_Co3 | colon | | | | pT7T3D-Pac (Pharmacia) with a modified polylinker |
| L0765 | NCI_CGAP_Co4 | colon | | | | pT7T3D-Pac (Pharmacia) with a modified polylinker |
| L0766 | NCI_CGAP_GCB1 | germinal center B cell | | | | pT7T3D-Pac (Pharmacia) with a modified polylinker |
| L0767 | NCI_CGAP_GC3 | pooled germ cell tumors | | | | pT7T3D-Pac (Pharmacia) with a modified polylinker |
| L0768 | NCI_CGAP_GC4 | pooled germ cell tumors | | | | pT7T3D-Pac (Pharmacia) with a modified polylinker |
| L0769 | NCI_CGAP_Brn25 | anaplastic oligodendroglioma | brain | | | pT7T3D-Pac (Pharmacia) with a modified polylinker |
| L0770 | NCI_CGAP_Brn23 | glioblastoma (pooled) | brain | | | pT7T3D-Pac (Pharmacia) with a modified polylinker |
| L0771 | NCI_CGAP_Co8 | adenocarcinoma | colon | | | pT7T3D-Pac (Pharmacia) with a modified polylinker |
| L0772 | NCI_CGAP_Co10 | colon tumor RER+ | colon | | | pT7T3D-Pac (Pharmacia) with a modified polylinker |
| L0773 | NCI_CGAP_Co9 | colon tumor RER+ | colon | | | pT7T3D-Pac (Pharmacia) with a modified polylinker |
| L0774 | NCI_CGAP_Kid3 | | kidney | | | pT7T3D-Pac (Pharmacia) with a modified polylinker |
| L0775 | NCI_CGAP_Kid5 | 2 pooled tumors (clear cell type) | kidney | | | pT7T3D-Pac (Pharmacia) with a modified polylinker |
| L0776 | NCI_CGAP_Lu5 | carcinoid | lung | | | pT7T3D-Pac (Pharmacia) with a modified polylinker |
| L0777 | Soares_NhHMPu_S1 | Pooled human melanocyte, fetal heart, and pregnant | mixed (see below) | | | pT7T3D-Pac (Pharmacia) with a modified polylinker |
| L0778 | Barstead pancreas HPLRB1 | | pancreas | | | pT7T3D-Pac (Pharmacia) with a modified polylinker |
| L0779 | Soares_NFL_T_GBC_S1 | | pooled | | | pT7T3D-Pac (Pharmacia) with a modified polylinker |

TABLE 4-continued

| Code | Description | Tissue | Organ | Cell Line | Disease | Vector |
|---|---|---|---|---|---|---|
| L0780 | Soares_NSF_F8_9W_OT_PA_P_S1 | | pooled | | | pT7T3D-Pac (Pharmacia) with a modified polylinker |
| L0782 | NCI_CGAP_Pr21 | normal prostate | prostate | | | pT7T3D-Pac (Pharmacia) with a modified polylinker |
| L0783 | NCI_CGAP_Pr22 | normal prostate | prostate | | | pT7T3D-Pac (Pharmacia) with a modified polylinker |
| L0784 | NCI_CGAP_Lei2 | leiomyosarcoma | soft tissue | | | pT7T3D-Pac (Pharmacia) with a modified polylinker |
| L0785 | Barstead spleen HPLRB2 | | spleen | | | pT7T3D-Pac (Pharmacia) with a modified polylinker |
| L0786 | Soares_NbHFB | | whole brain | | | pT7T3D-Pac (Pharmacia) with a modified polylinker |
| L0787 | NCI_CGAP_Sub1 | | | | | pT7T3D-Pac (Pharmacia) with a modified polylinker |
| L0788 | NCI_CGAP_Sub2 | | | | | pT7T3D-Pac (Pharmacia) with a modified polylinker |
| L0789 | NCI_CGAP_Sub3 | | | | | pT7T3D-Pac (Pharmacia) with a modified polylinker |
| L0790 | NCI_CGAP_Sub4 | | | | | pT7T3D-Pac (Pharmacia) with a modified polylinker |
| L0791 | NCI_CGAP_Sub5 | | | | | pT7T3D-Pac (Pharmacia) with a modified polylinker |
| L0792 | NCI_CGAP_Sub6 | | | | | pT7T3D-Pac (Pharmacia) with a modified polylinker |
| L0793 | NCI_CGAP_Sub7 | | | | | pT7T3D-Pac (Pharmacia) with a modified polylinker |
| L0794 | NCI_CGAP_GC6 | pooled germ cell tumors | | | | pT7T3D-Pac (Pharmacia) with a modified polylinker |
| L0796 | NCI_CGAP_Brn50 | medulloblastoma | brain | | | pT7T3D-Pac (Pharmacia) with a modified polylinker |
| L0800 | NCI_CGAP_Co16 | colon tumor, RER+ | colon | | | pT7T3D-Pac (Pharmacia) with a modified polylinker |
| L0803 | NCI_CGAP_Kid11 | | kidney | | | pT7T3D-Pac (Pharmacia) with a modified polylinker |
| L0804 | NCI_CGAP_Kid12 | 2 pooled tumors (clear cell type) | kidney | | | pT7T3D-Pac (Pharmacia) with a modified polylinker |
| L0805 | NCI_CGAP_Lu24 | carcinoid | lung | | | pT7T3D-Pac (Pharmacia) with a modified polylinker |

TABLE 4-continued

| Code | Description | Tissue | Organ | Cell Line | Disease | Vector |
|---|---|---|---|---|---|---|
| L0806 | NCI_CGAP_Lu19 | squamous cell carcinoma, poorly differentiated (4 | lung | | | pT7T3D-Pac (Pharmacia) with a modified polylinker |
| L0807 | NCI_CGAP_Ov18 | fibrotheoma | ovary | | | pT7T3D-Pac (Pharmacia) with a modified polylinker |
| L0808 | Barstead prostate BPH HPLRB4 1 | | prostate | | | pT7T3D-Pac (Pharmacia) with a modified polylinker |
| L0809 | NCI_CGAP_Pr28 | | prostate | | | pT7T3D-Pac (Pharmacia) with a modified polylinker |
| L0811 | BATM2 | | | | | PTZ18 |
| L0879 | BT0254 | | breast | | | puc18 |
| L0930 | BT0314 | | breast | | | puc18 |
| L0946 | BT0333 | | breast | | | puc18 |
| L0988 | BT0387 | | breast | | | puc18 |
| L1057 | BT0559 | | breast | | | puc18 |
| L1278 | BN0005 | | breast_normal | | | puc18 |
| L1441 | CT0249 | | colon | | | puc18 |
| L1446 | CT0254 | | colon | | | puc18 |
| L1477 | CT0297 | | colon | | | puc18 |
| L1499 | CT0322 | | colon | | | puc18 |
| L1548 | CN0007 | | colon_normal | | | puc18 |
| L1561 | CN0026 | | colon_normal | | | puc18 |
| L1607 | DT0041 | | denis_drash | | | puc18 |
| L1651 | HT0059 | | head_neck | | | puc18 |
| L1727 | HT0158 | | head_neck | | | puc18 |
| L1788 | HT0229 | | head_neck | | | puc18 |
| L1819 | HT0268 | | head_neck | | | puc18 |
| L1872 | HT0335 | | head_neck | | | puc18 |
| L1877 | HT0340 | | head_neck | | | puc18 |
| L1878 | HT0342 | | head_neck | | | puc18 |
| L1886 | HT0350 | | head_neck | | | puc18 |
| L1894 | HT0366 | | head_neck | | | puc18 |
| L1942 | HT0452 | | head_neck | | | puc18 |
| L1948 | HT0470 | | head_neck | | | puc18 |
| L2094 | ST0125 | | stomach | | | puc18 |
| L2138 | ST0186 | | stomach | | | puc18 |
| L2174 | ST0240 | | stomach | | | puc18 |
| L2197 | ST0278 | | stomach | | | puc18 |
| L2210 | ST0293 | | stomach | | | puc18 |
| L2242 | subtracted 3" EST library | | pancreas | AsPC-1(ATCC:CRL-1682) | | pUC18 |
| L2250 | Human cerebral cortex | cerebral cortex | | | | |
| L2251 | Human fetal lung | Fetal lung | | | | |
| L2252 | Human placenta | placenta | | | | |
| L2255 | GLC | corresponding non cancerous liver tissue | | | | pBluescript sk(−) |
| L2257 | NIH_MGC_65 | adenocarcinoma | colon | | | pCMV-SPORT6 |
| L2258 | NIH_MGC_67 | retinoblastoma | eye | | | pCMV-SPORT6 |
| L2259 | NIH_MGC_68 | large cell carcinoma | lung | | | pCMV-SPORT6 |
| L2260 | NIH_MGC_69 | large cell carcinoma, undifferentiated | lung | | | pCMV-SPORT6 |
| L2261 | NIH_MGC_70 | epithelioid carcinoma | pancreas | | | pCMV-SPORT6 |
| L2262 | NIH_MGC_72 | melanotic melanoma | skin | | | pCMV-SPORT6 |
| L2263 | NIH_MGC_66 | adenocarcinoma | ovary | | | pCMV-SPORT6 |
| L2264 | NIH_MGC_71 | leiomyosarcoma | uterus | | | pCMV-SPORT6 |
| L2265 | NIH_MGC_39 | adenocarcinoma | pancreas | | | pOTB7 |
| L2269 | NCI_CGAP_Thy11 | follicular carcinoma | thyroid | | | pAMP10 |
| L2270 | Lupski_dorsal_root_ganglion | dorsal root ganglia | | | | pCMV-SPORT6 (Life Technologies) |
| L2277 | BT0626 | | breast | | | puc18 |
| L2279 | BT0659 | | breast | | | puc18 |
| L2281 | BT0701 | | breast | | | puc18 |
| L2283 | BT0705 | | breast | | | puc18 |
| L2289 | BT0757 | | breast | | | puc18 |
| L2291 | BT0760 | | breast | | | puc18 |
| L2294 | BT0763 | | breast | | | puc18 |
| L2300 | BT0789 | | breast | | | puc18 |
| L2301 | BT0792 | | breast | | | puc18 |

TABLE 4-continued

| Code | Description | Tissue | Organ | Cell Line | Disease | Vector |
|---|---|---|---|---|---|---|
| L2308 | CT0383 | | colon | | | puc18 |
| L2317 | CT0400 | | colon | | | puc18 |
| L2328 | CT0412 | | colon | | | puc18 |
| L2332 | CT0416 | | colon | | | puc18 |
| L2333 | CT0417 | | colon | | | puc18 |
| L2336 | CT0428 | | colon | | | puc18 |
| L2338 | CT0432 | | colon | | | puc18 |
| L2339 | CT0434 | | colon | | | puc18 |
| L2346 | CT0483 | | colon | | | puc18 |
| L2348 | CT0491 | | colon | | | puc18 |
| L2353 | UT0003 | | uterus_tumor | | | puc18 |
| L2354 | UT0005 | | uterus_tumor | | | puc18 |
| L2357 | UT0021 | | uterus_tumor | | | puc18 |
| L2361 | UT0028 | | uterus_tumor | | | puc18 |
| L2364 | UT0033 | | uterus_tumor | | | puc18 |
| L2367 | UT0039 | | uterus_tumor | | | puc18 |
| L2372 | NN0034 | | nervous_normal | | | puc18 |
| L2377 | NN0054 | | nervous_normal | | | puc18 |
| L2380 | NN0068 | | nervous_normal | | | puc18 |
| L2382 | NN0073 | | nervous_normal | | | puc18 |
| L2389 | NN0087 | | nervous_normal | | | puc18 |
| L2400 | NN0116 | | nervous_normal | | | puc18 |
| L2402 | NN0118 | | nervous_normal | | | puc18 |
| L2412 | NN0136 | | nervous_normal | | | puc18 |
| L2413 | NN0141 | | nervous_normal | | | puc18 |
| L2439 | NN1022 | | nervous_normal | | | puc18 |
| L2440 | NN1023 | | nervous_normal | | | puc18 |
| L2449 | NN1063 | | nervous_normal | | | puc18 |
| L2450 | NN1065 | | nervous_normal | | | puc18 |
| L2462 | NN1089 | | nervous_normal | | | puc18 |
| L2464 | NN1104 | | nervous_normal | | | puc18 |
| L2466 | NN1111 | | nervous_normal | | | puc18 |
| L2467 | NN1112 | | nervous_normal | | | puc18 |
| L2471 | NN1123 | | nervous_normal | | | puc18 |
| L2472 | NN1124 | | nervous_normal | | | puc18 |
| L2477 | HT0408 | | head_neck | | | puc18 |
| L2478 | HT0445 | | head_neck | | | puc18 |
| L2487 | HT0542 | | head_neck | | | puc18 |
| L2490 | HT0545 | | head_neck | | | puc18 |
| L2491 | HT0559 | | head_neck | | | puc18 |
| L2493 | HT0576 | | head_neck | | | puc18 |
| L2494 | HT0577 | | head_neck | | | puc18 |
| L2495 | HT0594 | | head_neck | | | puc18 |
| L2497 | HT0618 | | head_neck | | | puc18 |
| L2498 | HT0619 | | head_neck | | | puc18 |
| L2499 | HT0622 | | head_neck | | | puc18 |
| L2500 | HT0623 | | head_neck | | | puc18 |
| L2504 | HT0636 | | head_neck | | | puc18 |
| L2506 | HT0638 | | head_neck | | | puc18 |
| L2513 | HT0678 | | head_neck | | | puc18 |
| L2518 | HT0697 | | head_neck | | | puc18 |
| L2519 | HT0698 | | head_neck | | | puc18 |
| L2521 | HT0702 | | head_neck | | | puc18 |
| L2522 | HT0704 | | head_neck | | | puc18 |
| L2525 | HT0710 | | head_neck | | | puc18 |
| L2535 | HT0723 | | head_neck | | | puc18 |
| L2539 | HT0727 | | head_neck | | | puc18 |
| L2540 | HT0728 | | head_neck | | | puc18 |
| L2543 | HT0734 | | head_neck | | | puc18 |
| L2545 | HT0736 | | head_neck | | | puc18 |
| L2550 | HT0743 | | head_neck | | | puc18 |
| L2552 | HT0745 | | head_neck | | | puc18 |
| L2558 | HT0756 | | head_neck | | | puc18 |
| L2560 | HT0758 | | head_neck | | | puc18 |
| L2562 | HT0760 | | head_neck | | | puc18 |
| L2565 | HT0764 | | head_neck | | | puc18 |
| L2570 | HT0771 | | head_neck | | | puc18 |
| L2571 | HT0773 | | head_neck | | | puc18 |
| L2578 | HT0785 | | head_neck | | | puc18 |
| L2581 | HT0790 | | head_neck | | | puc18 |
| L2587 | HT0797 | | head_neck | | | puc18 |
| L2596 | HT0807 | | head_neck | | | puc18 |
| L2598 | HT0809 | | head_neck | | | puc18 |
| L2599 | HT0810 | | head_neck | | | puc18 |
| L2610 | HT0837 | | head_neck | | | puc18 |
| L2615 | HT0843 | | head_neck | | | puc18 |
| L2618 | HT0847 | | head_neck | | | puc18 |

TABLE 4-continued

| Code | Description | Tissue | Organ | Cell Line | Disease | Vector |
|---|---|---|---|---|---|---|
| L2630 | HT0865 | | head_neck | | | puc18 |
| L2634 | HT0872 | | head_neck | | | puc18 |
| L2635 | HT0875 | | head_neck | | | puc18 |
| L2637 | HT0877 | | head_neck | | | puc18 |
| L2638 | HT0878 | | head_neck | | | puc18 |
| L2640 | HT0881 | | head_neck | | | puc18 |
| L2644 | HT0886 | | head_neck | | | puc18 |
| L2647 | HT0894 | | head_neck | | | puc18 |
| L2649 | HT0905 | | head_neck | | | puc18 |
| L2650 | HT0934 | | head_neck | | | puc18 |
| L2651 | NIH_MGC_20 | melanotic melanoma | skin | | | pOTB7 |
| L2652 | NIH_MGC_57 | glioblastoma | brain | | | pDNR-LIB (CLONTECH ™) |
| L2653 | NIH_MGC_58 | hypernephroma | kidney | | | pDNR-LIB (CLONTECH ™) |
| L2654 | NIH_MGC_9 | adenocarcinoma cell line | ovary | | | pOTB7 |
| L2655 | NIH_MGC_55 | from acute myelogenous leukemia | bone marrow | | | pDNR-LIB (CLONTECH ™) |
| L2657 | NIH_MGC_54 | from chronic myelogenous leukemia | bone marrow | | | pDNR-LIB (CLONTECH ™) |
| L2667 | NT0013 | | nervous_tumor | | | puc18 |
| L2668 | NT0018 | | nervous_tumor | | | puc18 |
| L2669 | NT0022 | | nervous_tumor | | | puc18 |
| L2670 | NT0023 | | nervous_tumor | | | puc18 |
| L2671 | NT0024 | | nervous_tumor | | | puc18 |
| L2673 | NT0028 | | nervous_tumor | | | puc18 |
| L2674 | NT0029 | | nervous_tumor | | | puc18 |
| L2675 | NT0033 | | nervous_tumor | | | puc18 |
| L2677 | NT0039 | | nervous_tumor | | | puc18 |
| L2681 | NT0048 | | nervous_tumor | | | puc18 |
| L2683 | NT0053 | | nervous_tumor | | | puc18 |
| L2686 | NT0058 | | nervous_tumor | | | puc18 |
| L2689 | NT0073 | | nervous_tumor | | | puc18 |
| L2696 | NT0084 | | nervous_tumor | | | puc18 |
| L2702 | NT0098 | | nervous_tumor | | | puc18 |
| L2705 | NT0101 | | nervous_tumor | | | puc18 |
| L2706 | NT0102 | | nervous_tumor | | | puc18 |
| L2708 | NT0104 | | nervous_tumor | | | puc18 |
| L2709 | NT0105 | | nervous_tumor | | | puc18 |
| L2716 | NT0117 | | nervous_tumor | | | puc18 |
| L2730 | GN0021 | | placenta_normal | | | puc18 |
| L2731 | GN0023 | | placenta_normal | | | puc18 |
| L2733 | GN0037 | | placenta_normal | | | puc18 |
| L2737 | GN0047 | | placenta_normal | | | puc18 |
| L2738 | GN0049 | | placenta_normal | | | puc18 |
| L2744 | FT0004 | | prostate_tumor | | | puc18 |
| L2754 | FT0022 | | prostate_tumor | | | puc18 |
| L2755 | FT0023 | | prostate_tumor | | | puc18 |
| L2756 | FT0024 | | prostate_tumor | | | puc18 |
| L2757 | FT0025 | | prostate_tumor | | | puc18 |
| L2763 | FT0039 | | prostate_tumor | | | puc18 |
| L2766 | FT0042 | | prostate_tumor | | | puc18 |
| L2767 | FT0044 | | prostate_tumor | | | puc18 |
| L2771 | FT0050 | | prostate_tumor | | | puc18 |
| L2779 | FT0058 | | prostate_tumor | | | puc18 |
| L2788 | FT0071 | | prostate_tumor | | | puc18 |
| L2791 | FT0077 | | prostate_tumor | | | puc18 |
| L2793 | FT0080 | | prostate_tumor | | | puc18 |
| L2799 | FT0096 | | prostate_tumor | | | puc18 |
| L2800 | FT0097 | | prostate_tumor | | | puc18 |
| L2804 | FT0103 | | prostate_tumor | | | puc18 |
| L2809 | FT0117 | | prostate_tumor | | | puc18 |
| L2810 | FT0119 | | prostate_tumor | | | puc18 |
| L2811 | FT0122 | | prostate_tumor | | | puc18 |
| L2812 | FT0123 | | prostate_tumor | | | puc18 |
| L2814 | FT0128 | | prostate_tumor | | | puc18 |
| L2815 | FT0129 | | prostate_tumor | | | puc18 |
| L2817 | FT0131 | | prostate_tumor | | | puc18 |
| L2819 | FT0134 | | prostate_tumor | | | puc18 |
| L2831 | FT0162 | | prostate_tumor | | | puc18 |
| L2833 | FT0164 | | prostate_tumor | | | puc18 |
| L2836 | FT0169 | | prostate_tumor | | | puc18 |
| L2842 | UM0009 | | uterus | | | puc18 |
| L2843 | UM0017 | | uterus | | | puc18 |
| L2844 | UM0018 | | uterus | | | puc18 |
| L2845 | UM0021 | | uterus | | | puc18 |
| L2846 | UM0022 | | uterus | | | puc18 |

TABLE 4-continued

| Code | Description | Tissue | Organ | Cell Line | Disease | Vector |
|---|---|---|---|---|---|---|
| L2848 | UM0053 | | uterus | | | puc18 |
| L2852 | UM0077 | | uterus | | | puc18 |
| L2854 | UM0091 | | uterus | | | puc18 |
| L2865 | AN0004 | | amnion_normal | | | puc18 |
| L2869 | AN0012 | | amnion_normal | | | puc18 |
| L2870 | AN0013 | | amnion_normal | | | puc18 |
| L2877 | AN0027 | | amnion_normal | | | puc18 |
| L2878 | AN0029 | | amnion_normal | | | puc18 |
| L2884 | AN0041 | | amnion_normal | | | puc18 |
| L2888 | AN0056 | | amnion_normal | | | puc18 |
| L2893 | AN0062 | | amnion_normal | | | puc18 |
| L2899 | AN0094 | | amnion_normal | | | puc18 |
| L2902 | BN0036 | | breast_normal | | | puc18 |
| L2904 | BN0042 | | breast_normal | | | puc18 |
| L2905 | BN0046 | | breast_normal | | | puc18 |
| L2906 | BN0047 | | breast_normal | | | puc18 |
| L2910 | BN0070 | | breast_normal | | | puc18 |
| L2914 | BN0090 | | breast_normal | | | puc18 |
| L2915 | BN0098 | | breast_normal | | | puc18 |
| L2918 | BN0114 | | breast_normal | | | puc18 |
| L2919 | BN0115 | | breast_normal | | | puc18 |
| L2924 | BN0138 | | breast_normal | | | puc18 |
| L2938 | BN0174 | | breast_normal | | | puc18 |
| L2962 | BN0221 | | breast_normal | | | puc18 |
| L2978 | BN0247 | | breast_normal | | | puc18 |
| L2985 | BN0257 | | breast_normal | | | puc18 |
| L2987 | BN0259 | | breast_normal | | | puc18 |
| L2991 | BN0264 | | breast_normal | | | puc18 |
| L2999 | BN0273 | | breast_normal | | | puc18 |
| L3001 | BN0275 | | breast_normal | | | puc18 |
| L3002 | BN0276 | | breast_normal | | | puc18 |
| L3010 | BN0294 | | breast_normal | | | puc18 |
| L3011 | BN0295 | | breast_normal | | | puc18 |
| L3012 | BN0296 | | breast_normal | | | puc18 |
| L3019 | BN0303 | | breast_normal | | | puc18 |
| L3020 | BN0304 | | breast_normal | | | puc18 |
| L3041 | BN0332 | | breast_normal | | | puc18 |
| L3058 | EN0004 | | lung_normal | | | puc18 |
| L3066 | EN0018 | | lung_normal | | | puc18 |
| L3071 | EN0026 | | lung_normal | | | puc18 |
| L3078 | EN0042 | | lung_normal | | | puc18 |
| L3080 | ET0001 | | lung_tumor | | | puc18 |
| L3081 | ET0005 | | lung_tumor | | | puc18 |
| L3089 | ET0018 | | lung_tumor | | | puc18 |
| L3092 | ET0023 | | lung_tumor | | | puc18 |
| L3093 | ET0024 | | lung_tumor | | | puc18 |
| L3095 | ET0027 | | lung_tumor | | | puc18 |
| L3104 | ET0041 | | lung_tumor | | | puc18 |
| L3109 | ET0046 | | lung_tumor | | | puc18 |
| L3111 | ET0058 | | lung_tumor | | | puc18 |
| L3117 | ET0068 | | lung_tumor | | | puc18 |
| L3118 | ET0070 | | lung_tumor | | | puc18 |
| L3119 | ET0072 | | lung_tumor | | | puc18 |
| L3127 | ET0084 | | lung_tumor | | | puc18 |
| L3128 | MT0016 | | marrow | | | puc18 |
| L3132 | MT0022 | | marrow | | | puc18 |
| L3134 | MT0024 | | marrow | | | puc18 |
| L3140 | MT0031 | | marrow | | | puc18 |
| L3144 | MT0035 | | marrow | | | puc18 |
| L3153 | MT0049 | | marrow | | | puc18 |
| L3154 | MT0050 | | marrow | | | puc18 |
| L3158 | MT0057 | | marrow | | | puc18 |
| L3160 | MT0059 | | marrow | | | puc18 |
| L3182 | MT0108 | | marrow | | | puc18 |
| L3184 | MT0111 | | marrow | | | puc18 |
| L3186 | MT0113 | | marrow | | | puc18 |
| L3199 | OT0019 | | ovary | | | puc18 |
| L3204 | OT0034 | | ovary | | | puc18 |
| L3207 | OT0063 | | ovary | | | puc18 |
| L3210 | OT0067 | | ovary | | | puc18 |
| L3211 | OT0072 | | ovary | | | puc18 |
| L3212 | OT0076 | | ovary | | | puc18 |
| L3213 | OT0078 | | ovary | | | puc18 |
| L3215 | OT0083 | | ovary | | | puc18 |
| L3216 | OT0086 | | ovary | | | puc18 |
| L3217 | OT0091 | | ovary | | | puc18 |
| L3226 | FN0019 | | prostate_normal | | | puc18 |

TABLE 4-continued

| Code | Description | Tissue | Organ | Cell Line | Disease | Vector |
|---|---|---|---|---|---|---|
| L3250 | FN0058 | | prostate_normal | | | puc18 |
| L3255 | FN0064 | | prostate_normal | | | puc18 |
| L3262 | FN0073 | | prostate_normal | | | puc18 |
| L3264 | FN0080 | | prostate_normal | | | puc18 |
| L3274 | FN0098 | | prostate_normal | | | puc18 |
| L3278 | FN0104 | | prostate_normal | | | puc18 |
| L3280 | FN0106 | | prostate_normal | | | puc18 |
| L3281 | FN0107 | | prostate_normal | | | puc18 |
| L3295 | FN0138 | | prostate_normal | | | puc18 |
| L3297 | FN0140 | | prostate_normal | | | puc18 |
| L3300 | FN0143 | | prostate_normal | | | puc18 |
| L3311 | FN0180 | | prostate_normal | | | puc18 |
| L3312 | FN0181 | | prostate_normal | | | puc18 |
| L3316 | FN0188 | | prostate_normal | | | puc18 |
| L3327 | SN0024 | | stomach_normal | | | puc18 |
| L3330 | SN0041 | | stomach_normal | | | puc18 |
| L3336 | SN0066 | | stomach_normal | | | puc18 |
| L3352 | TN0027 | | testis_normal | | | puc18 |
| L3355 | TN0032 | | testis_normal | | | puc18 |
| L3357 | TN0034 | | testis_normal | | | puc18 |
| L3358 | TN0035 | | testis_normal | | | puc18 |
| L3359 | TN0036 | | testis_normal | | | puc18 |
| L3369 | TN0065 | | testis_normal | | | puc18 |
| L3372 | TN0068 | | testis_normal | | | puc18 |
| L3374 | TN0070 | | testis_normal | | | puc18 |
| L3377 | TN0079 | | testis_normal | | | puc18 |
| L3378 | TN0080 | | testis_normal | | | puc18 |
| L3387 | GKB | hepatocellular carcinoma | | | | pBluescript sk(−) |
| L3388 | GKC | hepatocellular carcinoma | | | | pBluescript sk(−) |
| L3389 | GKD | hepatocellular carcinoma | | | | pBluescript sk(−) |
| L3391 | NIH_MGC_53 | carcinoma, cell line | bladder | | | pDNR-LIB (CLONTECH ™) |
| L3401 | AN0085 | | amnion_normal | | | puc18 |
| L3402 | AN0086 | | amnion_normal | | | puc18 |
| L3403 | AN0087 | | amnion_normal | | | puc18 |
| L3404 | AN0089 | | amnion_normal | | | puc18 |
| L3421 | BT0634 | | breast | | | puc18 |
| L3431 | CT0451 | | colon | | | puc18 |
| L3432 | CT0461 | | colon | | | puc18 |
| L3435 | CT0465 | | colon | | | puc18 |
| L3443 | CT0482 | | colon | | | puc18 |
| L3445 | CT0497 | | colon | | | puc18 |
| L3450 | CT0508 | | colon | | | puc18 |
| L3459 | FT0175 | | prostate_tumor | | | puc18 |
| L3463 | GN0016 | | placenta_normal | | | puc18 |
| L3464 | GN0018 | | placenta_normal | | | puc18 |
| L3466 | GN0020 | | placenta_normal | | | puc18 |
| L3476 | GN0051 | | placenta_normal | | | puc18 |
| L3480 | GN0057 | | placenta_normal | | | puc18 |
| L3484 | GN0067 | | placenta_normal | | | puc18 |
| L3485 | GN0070 | | placenta_normal | | | puc18 |
| L3490 | GN0075 | | placenta_normal | | | puc18 |
| L3491 | GN0076 | | placenta_normal | | | puc18 |
| L3494 | HT0539 | | head_neck | | | puc18 |
| L3495 | HT0570 | | head_neck | | | puc18 |
| L3496 | HT0572 | | head_neck | | | puc18 |
| L3497 | HT0600 | | head_neck | | | puc18 |
| L3499 | HT0617 | | head_neck | | | puc18 |
| L3503 | HT0870 | | head_neck | | | puc18 |
| L3504 | HT0873 | | head_neck | | | puc18 |
| L3506 | HT0879 | | head_neck | | | puc18 |
| L3511 | HT0900 | | head_neck | | | puc18 |
| L3516 | HT0913 | | head_neck | | | puc18 |
| L3518 | HT0915 | | head_neck | | | puc18 |
| L3520 | HT0918 | | head_neck | | | puc18 |
| L3521 | HT0919 | | head_neck | | | puc18 |
| L3526 | HT0931 | | head_neck | | | puc18 |
| L3530 | HT0939 | | head_neck | | | puc18 |
| L3540 | MT0126 | | marrow | | | puc18 |
| L3546 | NN0044 | | nervous_normal | | | puc18 |
| L3554 | OT0035 | | ovary | | | puc18 |
| L3561 | TN0025 | | testis_normal | | | puc18 |
| L3562 | TN0030 | | testis_normal | | | puc18 |
| L3563 | TN0037 | | testis_normal | | | puc18 |
| L3565 | TN0045 | | testis_normal | | | puc18 |
| L3586 | TN0120 | | testis_normal | | | puc18 |
| L3592 | TN0129 | | testis_normal | | | puc18 |

TABLE 4-continued

| Code | Description | Tissue | Organ | Cell Line | Disease | Vector |
|---|---|---|---|---|---|---|
| L3603 | UM0093 | | uterus | | | puc18 |
| L3605 | UM0104 | | uterus | | | puc18 |
| L3609 | UT0007 | | uterus_tumor | | | puc18 |
| L3612 | UT0011 | | uterus_tumor | | | puc18 |
| L3618 | UT0050 | | uterus_tumor | | | puc18 |
| L3625 | UT0063 | | uterus_tumor | | | puc18 |
| L3630 | UT0071 | | uterus_tumor | | | puc18 |
| L3631 | UT0072 | | uterus_tumor | | | puc18 |
| L3632 | UT0074 | | uterus_tumor | | | puc18 |
| L3634 | NIH_MGC_56 | primitive neuroectoderm | brain | | | pDNR-LIB (CLONTECH ™) |
| L3635 | NIH_MGC_62 | melanotic melanoma, high MDR | skin | | | pDNR-LIB (CLONTECH ™) |
| L3636 | NIH_MGC_73 | | brain | | | pDNR-LIB (CLONTECH ™) |
| L3637 | NIH_MGC_74 | | heart | | | pDNR-LIB (CLONTECH ™) |
| L3638 | NIH_MGC_78 | | pancreas | | | pDNR-LIB (CLONTECH ™) |
| L3641 | NIH_MGC_83 | | prostate | | | pDNR-LIB (CLONTECH ™) |
| L3642 | ADA | Adrenal gland | | | | pBluescript sk(−) |
| L3643 | ADB | Adrenal gland | | | | pBluescript sk(−) |
| L3644 | ADC | Adrenal gland | | | | pBluescript sk(−) |
| L3645 | Cu | adrenal cortico adenoma for Cushing''s syndrome | | | | pBluescript sk(−) |
| L3646 | DCA | | | | | pTrip1Ex2 |
| L3647 | Human HO-1 melanoma cells | | | | | |
| L3649 | DCB | | | | | pTrip1Ex2 |
| L3651 | FHTA | hypothalamus | | | | pTrip1Ex2 |
| L3652 | FHTB | hypothalamus | | | | pTrip1Ex2 |
| L3653 | HTB | Hypothalamus | | | | pBluescript sk(−) |
| L3655 | HTC | Hypothalamus | | | | pBluescript sk(−) |
| L3656 | HTE | Hypothalamus | | | | pBluescript sk(−) |
| L3657 | HTF | Hypothalamus | | | | pBluescript sk(−) |
| L3658 | cdA | pheochromocytoma | | | | pTrip1Ex2 |
| L3659 | CB | cord blood | | | | pBluescript |
| L3661 | NPA | pituitary | | | | pBluescript sk(−) |
| L3663 | NIH_MGC_60 | adenocarcinoma | prostate | | | pDNR-LIB (CLONTECH ™) |
| L3664 | NIH_MGC_61 | embryonal carcinoma | testis | | | pDNR-LIB (CLONTECH ™) |
| L3665 | NIH_MGC_75 | | kidney | | | pDNR-LIB (CLONTECH ™) |
| L3666 | NIH_MGC_77 | | lung | | | pDNR-LIB (CLONTECH ™) |
| L3667 | NIH_MGC_79 | | placenta | | | pDNR-LIB (CLONTECH ™) |
| L3668 | AN0063 | | amnion_normal | | | puc18 |
| L3672 | AN0083 | | amnion_normal | | | puc18 |
| L3673 | AN0084 | | amnion_normal | | | puc18 |
| L3684 | BT0812 | | breast | | | puc18 |
| L3693 | CI0018 | | colon_ins | | | puc18 |
| L3697 | CS0012 | | colon_est | | | puc18 |
| L3699 | CT0437 | | colon | | | puc18 |
| L3705 | CT0486 | | colon | | | puc18 |
| L3709 | CT0515 | | colon | | | puc18 |
| L3713 | CT0524 | | colon | | | puc18 |
| L3718 | CT0532 | | colon | | | puc18 |
| L3722 | GN0030 | | placenta_normal | | | puc18 |
| L3724 | GN0034 | | placenta_normal | | | puc18 |
| L3728 | GN0077 | | placenta_normal | | | puc18 |
| L3729 | GN0079 | | placenta_normal | | | puc18 |
| L3738 | GN0092 | | placenta_normal | | | puc18 |
| L3739 | HT0540 | | head_neck | | | puc18 |
| L3744 | HT0916 | | head_neck | | | puc18 |
| L3750 | HT0945 | | head_neck | | | puc18 |
| L3752 | HT0947 | | head_neck | | | puc18 |
| L3761 | NN1141 | | nervous_normal | | | puc18 |
| L3763 | SN0036 | | stomach_normal | | | puc18 |
| L3768 | TN0073 | | testis_normal | | | puc18 |
| L3778 | TN0112 | | testis_normal | | | puc18 |
| L3783 | TN0136 | | testis_normal | | | puc18 |
| L3790 | TN0150 | | testis_normal | | | puc18 |
| L3802 | UT0052 | | uterus_tumor | | | puc18 |
| L3804 | UT0073 | | uterus_tumor | | | puc18 |

TABLE 4-continued

| Code | Description | Tissue | Organ | Cell Line | Disease | Vector |
|---|---|---|---|---|---|---|
| L3805 | UT0075 | | uterus_tumor | | | puc18 |
| L3807 | UT0077 | | uterus_tumor | | | puc18 |
| L3808 | UT0078 | | uterus_tumor | | | puc18 |
| L3811 | NPC | pituitary | | | | pBluescript sk(−) |
| L3812 | NPD | pituitary | | | | pBluescript sk(−) |
| L3813 | TP | pituitary tumor | | | | pTrip1Ex2 |
| L3814 | BM | Bone marrow | | | | pTrip1Ex2 |
| L3815 | MDS | Bone marrow | | | | pTrip1Ex2 |
| L3816 | HEMBA1 | whole embryo, mainly head | | | | pME18SFL3 |
| L3817 | HEMBB1 | whole embryo, mainly body | | | | pME18SFL3 |
| L3818 | MAMMA1 | mammary gland | | | | pME18SFL3 |
| L3819 | NIH_MGC_76 | | liver | | | pDNR-LIB (CLONTECH ™) |
| L3820 | NIH_MGC_46 | leiomyosarcoma cell line | uterus | | | pOTB7 |
| L3821 | NIH_MGC_48 | primary B-cells from tonsils (cell line) | B-cells | | | pOTB7 |
| L3822 | NIH_MGC_59 | mucoepidermoid carcinoma | lung | | | pDNR-LIB (CLONTECH ™) |
| L3823 | NT2RM1 | | | NT2 | | pUC19FL3 |
| L3824 | NT2RM2 | | | NT2 | | pME18SFL3 |
| L3825 | NT2RM4 | | | NT2 | | pME18SFL3 |
| L3826 | NT2RP1 | | | NT2 | | pUC19FL3 |
| L3827 | NT2RP2 | | | NT2 | | pME18SFL3 |
| L3828 | NT2RP3 | | | NT2 | | pME18SFL3 |
| L3829 | NT2RP4 | | | NT2 | | pME18SFL3 |
| L3831 | OVARC1 | ovary, tumor tissue | | | | pME18SFL3 |
| L3832 | PLACE1 | placenta | | | | pME18SFL3 |
| L3833 | PLACE2 | placenta | | | | pME18SFL3 |
| L3834 | PLACE3 | placenta | | | | pME18SFL3 |
| L3835 | PLACE4 | placenta | | | | pME18SFL3 |
| L3836 | SKNMC1 | | | SK-N-MC | | pME18SFL3 |
| L3837 | THYRO1 | thyroid gland | | | | pME18SFL3 |
| L3839 | Y79AA1 | | | Y79 | | pME18SFL3 |
| L3841 | NIH_MGC_18 | large cell carcinoma | lung | | | pOTB7 |
| L3854 | BT0817 | | breast | | | puc18 |
| L3871 | NIH_MGC_19 | neuroblastoma | brain | | | pOTB7 |
| L3872 | NCI_CGAP_Skn1 | | skin, normal, 4 pooled sa | | | pCMV-SPORT6 |
| L3873 | Human esophageal carcinoma mRNA | esophageal squamous cell carcinoma | | | | pGEM-T (Promega) |
| L3904 | NCI_CGAP_Brn64 | glioblastoma with EGFR amplification | brain | | | pCMV-SPORT6 |
| L3905 | NCI_CGAP_Brn67 | anaplastic oligodendroglioma with 1p/19q loss | brain | | | pCMV-SPORT6 |
| L4497 | NCI_CGAP_Br22 | invasive ductal carcinoma, 3 pooled samples | breast | | | pCMV-SPORT6 |
| L4500 | NCI_CGAP_HN16 | moderate to poorly differentiated invasive carcino | mouth | | | pAMP10 |
| L4501 | NCI_CGAP_Sub8 | | | | | pT7T3D-Pac (Pharmacia) with a modified polylinker |
| L4507 | NCI_CGAP_Thy6 | normal epithelium | thyroid | | | pAMP10 |
| L4508 | NCI_CGAP_Thy8 | normal epithelium | thyroid | | | pAMP10 |
| L4535 | NCI_CGAP_Thy4 | normal epithelium | thyroid | | | pAMP10 |
| L4537 | NCI_CGAP_Thy7 | follicular adenoma (benign lesion) | thyroid | | | pAMP10 |
| L4556 | NCI_CGAP_HN13 | squamous cell carcinoma | tongue | | | pCMV-SPORT6 |
| L4557 | NCI_CGAP_Adr1 | neuroblastoma | adrenal gland | | | pCMV-SPORT6 |
| L4558 | NCI_CGAP_Pan3 | | pancreas | | | pCMV-SPORT6 |
| L4559 | NCI_CGAP_Thy3 | follicular carcinoma | thyroid | | | pCMV-SPORT6 |
| L4560 | NCI_CGAP_Ut7 | tumor | uterus | | | pCMV-SPORT6 |
| L4669 | NCI_CGAP_Ov41 | serous papillary tumor | ovary | | | pCMV-SPORT6 |
| L4747 | NCI_CGAP_Brn41 | oligodendroglioma | brain | | | pT7T3D-PAc (Pharmacia) with a modified polylinker |
| L4753 | NCI_CGAP_HN15 | leukoplakia of the buccal mucosa | mouth | | | pAMP10 |
| L5286 | NCI_CGAP_Thy10 | medullary carcinomal | thyroid | | | pAMP10 |

TABLE 4-continued

| Code | Description | Tissue | Organ | Cell Line | Disease | Vector |
|---|---|---|---|---|---|---|
| L5564 | NCI_CGAP_HN20 | | normal head/neck tissue | | | pAMP1 |
| L5565 | NCI_CGAP_Brn66 | glioblastoma with probably TP53 mutation and witho | brain | | | pCMV-SPORT6 |
| L5566 | NCI_CGAP_Brn70 | anaplastic oligodendroglioma | brain | | | pCMV-SPORT6.ccdb |
| L5568 | NCI_CGAP_HN21 | nasopharyngeal carcinoma | head/neck | | | pAMP1 |
| L5569 | NCI_CGAP_HN17 | normal epithelium | nasopharynx | | | pAMP10 |
| L5570 | NCI_CGAP_Co28 | normal colonic mucosa | colon | | | pAMP1 |
| L5574 | NCI_CGAP_HN19 | normal epithelium | nasopharynx | | | pAMP10 |
| L5575 | NCI_CGAP_Brn65 | glioblastoma without EGFR amplification | brain | | | pCMV-SPORT6 |
| L5622 | NCI_CGAP_Skn3 | | skin | | | pCMV-SPORT6 |
| L5623 | NCI_CGAP_Skn4 | squamous cell carcinoma | skin | | | pCMV-SPORT6 |

Description of Table 5

Table 5 provides a key to the OMIM reference identification numbers disclosed in Table 1B.1, column 9. OMIM reference identification numbers (Column 1) were derived from Online Mendelian Inheritance in Man (Online Mendelian Inheritance in Man, OMIM. McKusick-Nathans Institute for Genetic Medicine, Johns Hopkins University (Baltimore, Md.) and National Center for Biotechnology Information, National Library of Medicine, (Bethesda, Md.) 2000. World Wide Web URL: www.ncbi.nlm.nih.gov/omim/). Column 2 provides diseases associated with the cytologic band disclosed in Table 1B.1, column 8, as determined using the Morbid Map database.

TABLE 5

| OMIM Reference | Description |
|---|---|
| 100678 | ACAT2 deficiency |
| 100690 | Myasthenic syndrome, slow-channel congenital, 601462 |
| 100710 | Myasthenic syndrome, slow-channel congenital, 601462 |
| 100730 | Myasthenia gravis, neonatal transient |
| 101000 | Meningioma, NF2-related, sporadic Schwannoma, sporadic |
| 101000 | Neurofibromatosis, type 2 |
| 101000 | Neurolemmomatosis |
| 101000 | Malignant mesothelioma, sporadic |
| 102200 | Somatotrophinoma |
| 102480 | Male infertility due to acrosin deficiency |
| 102540 | Cardiomyopathy, idiopathic dilated |
| 102578 | Leukemia, acute promyelocytic, PML/RARA type |
| 102770 | Myoadenylate deaminase deficiency |
| 102772 | [AMP deaminase deficiency, erythrocytic] |
| 103000 | Hemolytic anemia due to adenylate kinase deficiency |
| 103050 | Autism, succinylpurinemic |
| 103050 | Adenylosuccinase deficiency |
| 103581 | Albright hereditary osteodystrophy-2 |
| 103600 | [Dysalbuminemic hyperthyroxinemia] |
| 103600 | [Dysalbuminemic hyperzincemia], 194470 |
| 103600 | Analbuminemia |
| 103720 | Alcoholism, susceptibility to |
| 103850 | Aldolase A deficiency |
| 103950 | Emphysema due to alpha-2-macroglobulin deficiency |
| 104150 | [AFP deficiency, congenital] |
| 104150 | [Hereditary persistence of alpha-fetoprotein] |
| 104170 | NAGA deficiency, mild |
| 104170 | Schindler disease |
| 104170 | Kanzaki disease |
| 104311 | Alzheimer disease-3 |
| 104500 | Amelogenesis imperfecta-2, hypoplastic local type |
| 104770 | Amyloidosis, secondary, susceptibility to |
| 106100 | Angioedema, hereditary |
| 106150 | Hypertension, essential, susceptibility to |
| 106150 | Preeclampsia, susceptibility to |
| 106165 | Hypertension, essential, 145500 |

TABLE 5-continued

| OMIM Reference | Description |
|---|---|
| 106180 | Myocardial infarction, susceptibility to |
| 106210 | Peters anomaly |
| 106210 | Cataract, congenital, with late-onset corneal dystrophy |
| 106210 | Foveal hypoplasia, isolated, 136520 |
| 106210 | Aniridia |
| 106300 | Ankylosing spondylitis |
| 107250 | Anterior segment mesenchymal dysgenesis |
| 107271 | CD59 deficiency |
| 107300 | Antithrombin III deficiency |
| 107470 | Atypical mycobacterial infection, familial disseminated, 209950 |
| 107470 | BCG infection, generalized familial |
| 107470 | Tuberculosis, susceptibility to |
| 107670 | Apolipoprotein A-II deficiency |
| 107680 | ApoA-I and apoC-III deficiency, combined |
| 107680 | Corneal clouding, autosomal recessive |
| 107680 | Amyloidosis, 3 or more types |
| 107680 | Hypertriglyceridemia, one form |
| 107680 | Hypoalphalipoproteinemia |
| 107720 | Hypertriglyceridemia |
| 107741 | Hyperlipoproteinemia, type III |
| 107776 | Colton blood group, 110450 |
| 107777 | Diabetes insipidus, nephrogenic, autosomal recessive, 222000 |
| 107970 | Arrhythmogenic right ventricular dysplasia-1 |
| 108120 | Distal arthrogryposis-1 |
| 108725 | Atherosclerosis, susceptibility to |
| 108730 | Brody myopathy, 601003 |
| 108800 | Atrial septal defect, secundum type |
| 108962 | Hypertension, salt-resistant |
| 108985 | Atrophia areata |
| 109150 | Machado-Joseph disease |
| 109270 | Renal tubular acidosis, distal, 179800 |
| 109270 | Spherocytosis, hereditary |
| 109270 | [Acanthocytosis, one form] |
| 109270 | [Elliptocytosis, Malaysian-Melanesian type] |
| 109270 | Hemolytic anemia due to band 3 defect |
| 109400 | Basal cell nevus syndrome |
| 109560 | Leukemia/lymphoma, B-cell, 3 |
| 109565 | Lymphoma, B-cell |
| 109565 | Lymphoma, diffuse large cell |
| 109690 | Asthma, nocturnal, susceptibility to |
| 109690 | Obesity, susceptibility to |
| 109700 | Hemodialysis-related amyloidosis |
| 110100 | Blepharophimosis, epicanthus inversus, and ptosis, type 1 |
| 110700 | Vivax malaria, susceptibility to |
| 112250 | Bone dysplasia with medullary fibrosarcoma |
| 112261 | Fibrodysplasia ossificans progressiva |
| 112262 | Fibrodysplasia ossificans progressiva, 135100 |
| 112410 | Hypertension with brachydactyly |
| 113100 | Brachydactyly, type C |
| 113520 | Hyperleucinemia-isoleucinemia or hypervalinemia |
| 113721 | Breast cancer |

TABLE 5-continued

| OMIM Reference | Description |
|---|---|
| 113811 | Epidermolysis bullosa, generalized atrophic benign, 226650 |
| 113900 | Heart block, progressive familial, type I |
| 114130 | Osteoporosis |
| 114208 | Malignant hyperthermia susceptibility 5, 601887 |
| 114208 | Hypokalemic periodic paralysis, 170400 |
| 114240 | Muscular dystrophy, limb-girdle, type 2A, 253600 |
| 114290 | Campomelic dysplasia with autosomal sex reversal |
| 114350 | Leukemia, acute myeloid |
| 114400 | Lynch cancer family syndrome II |
| 114550 | Hepatocellular carcinoma |
| 114835 | Monocyte carboxyesterase deficiency |
| 115470 | Cat eye syndrome |
| 115500 | Acatalasemia |
| 115660 | Cataract, cerulean, type 1 |
| 115665 | Cataract, congenital, Volkmann type |
| 116600 | Cataract, posterior polar |
| 116800 | Cataract, Marner type |
| 116806 | Colorectal cancer |
| 116860 | Cavernous angiomatous malformations |
| 117700 | [Hypoceruloplasminemia, hereditary] |
| 117700 | Hemosiderosis, systemic, due to aceruloplasminemia |
| 118210 | Charcot-Marie-Tooth neuropathy-2A |
| 118470 | [CETP deficiency] |
| 118485 | Polycystic ovary syndrome with hyperandrogenemia |
| 118504 | Epilepsy, benign neonatal, type 1, 121200 |
| 118504 | Epilepsy, nocturnal frontal lobe, 600513 |
| 118511 | Schizophrenia, neurophysiologic defect in |
| 118800 | Choreoathetosis, familial paroxysmal |
| 119300 | van der Woude syndrome |
| 119530 | Orofacial cleft-1 |
| 120070 | Alport syndrome, autosomal recessive, 203780 |
| 120110 | Metaphyseal chondrodysplasia, Schmid type |
| 120120 | Epidermolysis bullosa dystrophica, dominant, 131750 |
| 120120 | Epidermolysis bullosa dystrophica, recessive, 226600 |
| 120120 | Epidermolysis bullosa, pretibial, 131850 |
| 120131 | Alport syndrome, autosomal recessive, 203780 |
| 120131 | Hematuria, familial benign |
| 120140 | Osteoarthrosis, precocious |
| 120140 | SED congenita |
| 120140 | SMED Strudwick type |
| 120140 | Stickler syndrome, type I |
| 120140 | Wagner syndrome, type II |
| 120140 | Achondrogenesis-hypochondrogenesis, type II |
| 120140 | Kniest dysplasia |
| 120150 | Osteogenesis imperfecta, 4 clinical forms, 166200, 166210, 259420, 166220 |
| 120150 | Osteoporosis, idiopathic, 166710 |
| 120150 | Ehlers-Danlos syndrome, type VIIA1, 130060 |
| 120160 | Osteogenesis imperfecta, 4 clinical forms, 166200, 166210, 259420, 166220 |
| 120160 | Osteoporosis, idiopathic, 166710 |
| 120160 | Ehlers-Danlos syndrome, type VIIA2, 130060 |
| 120160 | Marfan syndrome, atypical |
| 120215 | Ehlers-Danlos syndrome, type I, 130000 |
| 120215 | Ehlers-Danlos syndrome, type II, 130010 |
| 120220 | Bethlem myopathy, 158810 |
| 120240 | Bethlem myopathy, 158810 |
| 120260 | Epiphyseal dysplasia, multiple, type 2, 600204 |
| 120290 | OSMED syndrome, 215150 |
| 120290 | Stickler syndrome, type II, 184840 |
| 120435 | Muir-Torre syndrome, 158320 |
| 120435 | Colorectal cancer, hereditary, nonpolyposis, type 1 Ovarian cancer |
| 120436 | Muir-Torre family cancer syndrome, 158320 |
| 120436 | Turcot syndrome with glioblastoma, 276300 |
| 120436 | Colorectal cancer, hereditary nonpolyposis, type 2 |
| 120550 | C1q deficiency, type A |
| 120570 | C1q deficiency, type B |
| 120575 | C1q deficiency, type C |
| 120580 | C1r/C1s deficiency, combined |
| 120620 | SLE susceptibility |
| 120620 | CR1 deficiency |
| 120700 | C3 deficiency |
| 120810 | C4 deficiency |
| 120820 | C4 deficiency |
| 120900 | C5 deficiency |
| 120920 | Measles, susceptibility to |
| 120950 | C8 deficiency, type I |
| 120960 | C8 deficiency, type II |
| 121011 | Deafness, autosomal dominant 3, 601544 |
| 121011 | Deafness, autosomal recessive 1, 220290 |
| 121014 | Heterotaxia, visceroatrial, autosomal recessive |
| 121050 | Contractural arachnodactyly, congenital |
| 121300 | Coproporphyria |
| 121300 | Harderoporphyrinuria |
| 121360 | Myeloid leukemia, acute, M4Eo subtype |
| 121800 | Corneal dystrophy, crystalline, Schnyder |
| 122720 | Nicotine addiction, protection from |
| 122720 | Coumarin resistance, 122700 |
| 123000 | Craniometaphyseal dysplasia |
| 123100 | Craniosynostosis, type 1 |
| 123101 | Craniosynostosis, type 2 |
| 123270 | [Creatine kinase, brain type, ectopic expression of] |
| 123580 | Cataract, congenital, autosomal dominant |
| 123620 | Cataract, cerulean, type 2, 601547 |
| 123660 | Cataract, Coppock-like |
| 123900 | White sponge nevus, 193900 |
| 124020 | Mephenytoin poor metabolizer |
| 124030 | Parkinsonism, susceptibility to |
| 124030 | Debrisoquine sensitivity |
| 124200 | Darier disease (keratosis follicularis) |
| 125264 | Leukemia, acute nonlymphocytic |
| 125270 | Porphyria, acute hepatic |
| 125270 | Lead poisoning, susceptibility to |
| 125370 | Dentatorubro-pallidoluysian atrophy |
| 125490 | Dentinogenesis imperfecta-1 |
| 125660 | Myopathy, desminopathic |
| 125660 | Cardiomyopathy |
| 125852 | Insulin-dependent diabetes mellitus-2 |
| 126060 | Anemia, megaloblastic, due to DHFR deficiency |
| 126090 | Hyperphenylalaninemia due to pterin-4a-carbinolamine dehydratase deficiency, 264070 |
| 126337 | Myxoid liposarcoma |
| 126340 | Xeroderma pigmentosum, group D, 278730 |
| 126391 | DNA ligase I deficiency |
| 126452 | Autonomic nervous system dysfunction |
| 126452 | [Novelty seeking personality] |
| 126600 | Doyne honeycomb retinal dystrophy |
| 126600 | Drusen, radial, autosomal dominant |
| 126650 | Chloride diarrhea, congenital, Finnish type, 214700 |
| 126650 | Colon cancer |
| 128100 | Dystonia-1, torsion |
| 129010 | Neuropathy, congenital hypomyelinating, 1 |
| 129490 | Ectodermal dysplasia-3, anhidrotic |
| 129500 | Ectodermal dysplasia, hidrotic |
| 129900 | EEC syndrome-1 |
| 130410 | Glutaricaciduria, type IIB |
| 130500 | Elliptocytosis-1 |
| 130650 | Beckwith-Wiedemann syndrome |
| 131100 | Multiple endocrine neoplasia I |
| 131100 | Prolactinoma, hyperparathyroidism, carcinoid syndrome |
| 131100 | Carcinoid tumor of lung |
| 131195 | Hereditary hemorrhagic telangiectasia-1, 187300 |
| 131210 | Atherosclerosis, susceptibility to |
| 131242 | Shah-Waardenburg syndrome, 277580 |
| 131244 | Hirschsprung disease-2, 600155 |
| 131400 | Eosinophilia, familial |
| 131440 | Eosinophilic myeloproliferative disorder |
| 131950 | Epidermolysis bullosa, Ogna type |
| 132700 | Cylindromatosis |
| 132800 | Basal cell carcinoma |
| 132800 | Epithelioma, self-healing, squamous 1, Ferguson-Smith type |
| 133171 | [Erythrocytosis, familial], 133100 |
| 133200 | Erythrokeratodermia variabilis |
| 133430 | Breast cancer |
| 133430 | Estrogen resistance |
| 133530 | Xeroderma pigmentosum, group G, 278780 |
| 133701 | Exostoses, multiple, type 2 |
| 133780 | Vitreoretinopathy, exudative, familial |
| 134370 | Membroproliferative glomerulonephritis |
| 134370 | Factor H deficiency |
| 134370 | Hemolytic-uremic syndrome, 235400 |

TABLE 5-continued

| OMIM Reference | Description |
|---|---|
| 134570 | Factor XIIIA deficiency |
| 134580 | Factor XIIIB deficiency |
| 134637 | Autoimmune lymphoproliferative syndrome |
| 134638 | Systemic lupus erythematosus, susceptibility, 152700 |
| 134790 | Hyperferritinemia-cataract syndrome, 600886 |
| 134820 | Dysfibrinogenemia, alpha type, causing bleeding diathesis |
| 134820 | Dysfibrinogenemia, alpha type, causing recurrent thrombosis |
| 134820 | Amyloidosis, hereditary renal, 105200 |
| 134830 | Dysfibrinogenemia, beta type |
| 134850 | Dysfibrinogenemia, gamma type |
| 134850 | Hypofibrinogenemia, gamma type |
| 134934 | Thanatophoric dysplasia, types I and II, 187600 |
| 134934 | Achondroplasia, 100800 |
| 134934 | Craniosynostosis, nonsyndromic |
| 134934 | Crouzon syndrome with acanthosis nigricans |
| 134934 | Hypochondroplasia, 146000 |
| 135300 | Fibromatosis, gingival |
| 135600 | Ehlers-Danlos syndrome, type X |
| 135700 | Fibrosis of extraocular muscles, congenital, 1 |
| 135940 | Ichthyosis vulgaris, 146700 |
| 136132 | [Fish-odor syndrome], 602079 |
| 136350 | Pfeiffer syndrome, 101600 |
| 136435 | Ovarian dysgenesis, hypergonadotropic, with normal karyotype, 233300 |
| 136530 | Male infertility, familial |
| 136550 | Macular dystrophy, North Carolina type |
| 136836 | Fucosyltransferase-6 deficiency |
| 137350 | Amyloidosis, Finnish type, 105120 |
| 137600 | Iridogoniodysgenesis syndrome |
| 138030 | [Hyperproglucagonemia] |
| 138033 | Diabetes mellitus, type II |
| 138040 | Cortisol resistance |
| 138079 | Hyperinsulinism, familial, 602485 |
| 138079 | MODY, type 2, 125851 |
| 138140 | Glucose transport defect, blood-brain barrier |
| 138160 | Diabetes mellitus, noninsulin-dependent |
| 138160 | Fanconi-Bickel syndrome, 227810 |
| 138190 | Diabetes mellitus, noninsulin-dependent |
| 138250 | P5CS deficiency |
| 138300 | Hemolytic anemia due to glutathione reductase deficiency |
| 138320 | Hemolytic anemia due to glutathione peroxidase deficiency |
| 138491 | Startle disease, autosomal recessive |
| 138491 | Startle disease/hyperekplexia, autosomal dominant, 149400 |
| 138491 | Hyperekplexia and spastic paraparesis |
| 138570 | Non-insulin dependent diabetes mellitus, susceptibility to |
| 138700 | [Apolipoprotein H deficiency] |
| 138760 | [Glyoxalase II deficiency] |
| 138971 | Kostmann neutropenia, 202700 |
| 138981 | Pulmonary alveolar proteinosis, 265120 |
| 139130 | Hypertension, essential, susceptibility to, 145500 |
| 139150 | Basal cell carcinoma |
| 139190 | Gigantism due to GHRF hypersecretion |
| 139190 | Isolated growth hormone deficiency due to defect in GHRF |
| 139191 | Growth hormone deficient dwarfism |
| 139250 | Isolated growth hormone deficiency, Illig type with absent GH and Kowarski type with bioinactive GH |
| 139320 | Pituitary ACTH secreting adenoma |
| 139320 | Pseudohypoparathyroidism, type Ia, 103580 |
| 139320 | Somatotrophinoma |
| 139320 | McCune-Albright polyostotic fibrous dysplasia, 174800 |
| 139350 | Epidermolytic hyperkeratosis, 113800 |
| 139350 | Keratoderma, palmoplantar, nonepidermolytic |
| 140100 | [Anhaptoglobinemia] |
| 140100 | [Hypohaptogloginemia] |
| 141750 | Alpha-thalassemia/mental retardation syndrome, type 1 |
| 141800 | Methemoglobinemias, alpha- |
| 141800 | Thalassemias, alpha- |
| 141800 | Erythremias, alpha- |
| 141800 | Heinz body anemias, alpha- |
| 141850 | Thalassemia, alpha- |
| 141850 | Erythrocytosis |
| 141850 | Heinz body anemia |
| 141850 | Hemoglobin H disease |
| 141850 | Hypochromic microcytic anemia |
| 141900 | Methemoglobinemias, beta- |
| 141900 | Sickle cell anemia |
| 141900 | Thalassemias, beta- |
| 141900 | Erythremias, beta- |
| 141900 | HPFH, deletion type |
| 141900 | Heinz body anemias, beta- |
| 142000 | Thalassemia due to Hb Lepore |
| 142000 | Thalassemia, delta- |
| 142200 | HPFH, nondeletion type A |
| 142250 | HPFH, nondeletion type G |
| 142270 | Hereditary persistence of fetal hemoglobin |
| 142335 | Hereditary persistence of fetal hemoglobin, heterocellular, Indian type |
| 142360 | Thrombophilia due to heparin cofactor II deficiency |
| 142380 | Hepatocellular carcinoma |
| 142470 | [Hereditary persistence of fetal hemoglobin, heterocellular] |
| 142600 | Hemolytic anemia due to hexokinase deficiency |
| 142640 | Thrombophilia due to elevated HRG |
| 142680 | Periodic fever, familial |
| 142857 | Pemphigoid, susceptibility to |
| 142858 | Beryllium disease, chronic, susceptibility to |
| 142959 | Hand-foot-uterus syndrome, 140000 |
| 142989 | Synpolydactyly, type II, 186000 |
| 143100 | Huntington disease |
| 143200 | Wagner syndrome |
| 143200 | Erosive vitreoretinopathy |
| 143890 | Hypercholesterolemia, familial |
| 144120 | Hyperimmunoglobulin G1 syndrome |
| 144200 | Epidermolytic palmoplantar keratoderma |
| 145001 | Hyperparathyroidism-jaw tumor syndrome |
| 145260 | Pseudohypoaldosteronism, type II |
| 145505 | Hypertension, essential |
| 145981 | Hypocalciuric hypercalcemia, type II |
| 146150 | Hypomelanosis of Ito |
| 146200 | Hypoparathyroidism, familial |
| 146740 | Neutropenia, alloimmune neonatal |
| 146740 | Viral infections, recurrent |
| 146740 | Lupus erythematosus, systemic, susceptibility, 152700 |
| 146760 | [IgG receptor I, phagocytic, familial deficiency of] |
| 146790 | Lupus nephritis, susceptibility to |
| 147020 | Agammaglobulinemia, 601495 |
| 147050 | Atopy |
| 147061 | Allergy and asthma susceptibility |
| 147110 | IgG2 deficiency, selective |
| 147141 | Leukemia, acute lymphoblastic |
| 147200 | [Kappa light chain deficiency] |
| 147280 | Hepatocellular carcinoma |
| 147440 | Growth retardation with deafness and mental retardation |
| 147575 | Myelodysplastic syndrome, preleukemic |
| 147575 | Myelogenous leukemia, acute |
| 147575 | Macrocytic anemia refractory, of 5q- syndrome, 153550 |
| 147670 | Rabson-Mendenhall syndrome |
| 147670 | Diabetes mellitus, insulin-resistant, with acanthosis nigricans |
| 147670 | Leprechaunism |
| 147680 | Severe combined immunodeficiency due to IL2 deficiency |
| 147730 | Interleukin-2 receptor, alpha chain, deficiency of |
| 147781 | Atopy, susceptibility to |
| 147790 | Leukemia, acute lymphocytic, with 4/11 translocation |
| 147791 | Jacobsen syndrome |
| 148040 | Epidermolysis bullosa simplex, Koebner, Dowling-Meara, and Weber-Cockayne types, 131900, 131760, 131800 |
| 148041 | Pachyonychia congenita, Jadassohn-Lewandowsky type, 167200 |
| 148043 | Meesmann corneal dystrophy, 122100 |
| 148045 | White sponge nevus, 193900 |
| 148066 | Epidermolysis bullosa simplex, Koebner, Dowling-Meara, and Weber-Cockayne types, 131900, 131760, 131800 |
| 148066 | Epidermolysis bullosa simplex, recessive, 601001 |
| 148067 | Nonepidermolytic palmoplantar keratoderma, 600962 |
| 148067 | Pachyonychia congenita, Jadassohn-Lewandowsky type, 167200 |
| 148069 | Pachyonychia congenita, Jackson-Lawler type, 167210 |
| 148070 | Liver disease, susceptibility to, from hepatotoxins or viruses |
| 148080 | Epidermolysis hyperkeratosis, 113800 |
| 148370 | Keratolytic winter erythema |
| 148500 | Tylosis with esophageal cancer |
| 148900 | Klippel-Feil syndrome with laryngeal malformation |
| 150000 | Exertional myoglobinuria due to deficiency of LDH-A |

TABLE 5-continued

| OMIM Reference | Description |
|---|---|
| 150100 | Lactate dehydrogenase-B deficiency |
| 150200 | [Placental lactogen deficiency] |
| 150210 | Lactoferrin-deficient neutrophils, 245480 |
| 150240 | Cutis laxa, marfanoid neonatal type |
| 150250 | Larsen syndrome, autosomal dominant |
| 150270 | Laryngeal adductor paralysis |
| 150292 | Epidermolysis bullosa, Herlitz junctional type, 226700 |
| 150310 | Epidermolysis bullosa, Herlitz junctional type, 226700 |
| 150310 | Epidermolysis bullosa, generalized atrophic benign, 226650 |
| 151385 | Leukemia, acute myeloid |
| 151390 | Leukemia, acute T-cell |
| 151400 | Leukemia/lymphoma, B-cell, 1 |
| 151410 | Leukemia, chronic myeloid |
| 151440 | Leukemia, T-cell acute lymphoblastoid |
| 151670 | Hepatic lipase deficiency |
| 152200 | Coronary artery disease, susceptibility to |
| 152427 | Long QT syndrome-2 |
| 152445 | Vohwinkel syndrome, 124500 |
| 152445 | Erythrokeratoderma, progressive symmetric, 602036 |
| 152760 | Hypogonadotropic hypogonadism due to GNRH deficiency, 227200 |
| 152780 | Hypogonadism, hypergonadotropic |
| 152780 | Male pseudohermaphroditism due to defective LH |
| 152790 | Precocious puberty, male, 176410 |
| 152790 | Leydig cell hypoplasia |
| 153454 | Ehlers-Danlos syndrome, type VI, 225400 |
| 153455 | Cutis laxa, recessive, type I, 219100 |
| 153700 | Macular dystrophy, vitelliform type |
| 153840 | Macular dystrophy, atypical vitelliform |
| 153880 | Macular dystrophy, dominant cystoid |
| 153900 | Stargardt disease-2 |
| 154275 | Malignant hyperthermia susceptibility 2 |
| 154276 | Malignant hyperthermia susceptibility 3 |
| 154400 | Acrofacial dysostosis, Nager type |
| 154500 | Treacher Collins mandibulofacial dysostosis |
| 154545 | Chronic infections, due to opsonin defect |
| 154550 | Carbohydrate-deficient glycoprotein syndrome, type Ib, 602579 |
| 154705 | Marfan syndrome, type II |
| 155555 | [Red hair/fair skin] |
| 155555 | UV-induced skin damage, vulnerability to |
| 155600 | Malignant melanoma, cutaneous |
| 156225 | Muscular dystrophy, congenital merosin-deficient |
| 156232 | Mesomelic dysplasia, Kantaputra type |
| 156600 | Microcoria, congenital |
| 156845 | Tietz syndrome, 103500 |
| 156845 | Waardenburg syndrome, type IIA, 193510 |
| 156845 | Waardenburg syndrome/ocular albinism, digenic, 103470 |
| 156850 | Cataract, congenital, with microphthalmia |
| 157140 | Dementia, frontotemporal, with parkinsonism, 601630 |
| 157147 | Abetalipoproteinemia, 200100 |
| 157170 | Holoprosencephaly-2 |
| 157640 | PEO with mitochondrial DNA deletions, type 1 |
| 157655 | Lactic acidosis due to defect in iron-sulfur cluster of complex I |
| 157900 | Moebius syndrome |
| 158590 | Spinal muscular atrophy-4 |
| 159000 | Muscular dystrophy, limb-girdle, type 1A |
| 159001 | Muscular dystrophy, limb-girdle, type 1B |
| 159440 | Charcot-Marie-Tooth neuropathy-1B, 118200 |
| 159440 | Dejerine-Sottas disease, myelin P-related, 145900 |
| 159440 | Hypomyelination, congenital |
| 159555 | Leukemia, myeloid/lymphoid or mixed-lineage |
| 159595 | Leukemia, transient, of Down syndrome |
| 160760 | Cardiomyopathy, familial hypertrophic, 1, 192600 |
| 160760 | Central core disease, one form |
| 160781 | Cardiomyopathy, hypertrophic, mid-left ventricular chamber type |
| 160900 | Myotonic dystrophy |
| 160980 | Carney myxoma-endocrine complex |
| 161015 | Mitochondrial complex I deficiency, 252010 |
| 162100 | Neuralgic amyotrophy with predilection for brachial plexus |
| 162150 | Obesity with impaired prohormone processing, 600955 |
| 162200 | Neurofibromatosis, type 1 |
| 162200 | Watson syndrome, 193520 |
| 162400 | Neuropathy, hereditary sensory and autonomic, type 1 |
| 163729 | Hypertension, pregnancy-induced |
| 163890 | Parkinson disease, type 1, 601508 |
| 163950 | Noonan syndrome-1 |
| 163950 | Cardiofaciocutaneous syndrome, 115150 |
| 164009 | Leukemia, acute promyelocytic, NUMA/RARA type |
| 164040 | Leukemia, acute promyelocytic, NPM/RARA type |
| 164200 | Oculodentodigital dysplasia |
| 164200 | Syndactyly, type III, 186100 |
| 164500 | Spinocerebellar ataxia-7 |
| 164731 | Ovarian carcinoma, 167000 |
| 164761 | Medullary thyroid carcinoma, 155240 |
| 164761 | Multiple endocrine neoplasia IIA, 171400 |
| 164761 | Multiple endocrine neoplasia IIB, 162300 |
| 164761 | Hirschsprung disease, 142623 |
| 164770 | Myeloid malignancy, predisposition to |
| 164920 | Piebaldism |
| 164920 | Mast cell leukemia |
| 164920 | Mastocytosis with associated hematologic disorder |
| 164953 | Liposarcoma |
| 165240 | Pallister-Hall syndrome, 146510 |
| 165240 | Postaxial polydactyly type A1, 174200 |
| 165240 | Greig cephalopolysyndactyly syndrome, 175700 |
| 165320 | Hepatocellular carcinoma |
| 165500 | Optic atrophy 1 |
| 166800 | Otosclerosis |
| 167000 | Ovarian cancer, serous |
| 167250 | Paget disease of bone |
| 167409 | Optic nerve coloboma with renal disease, 120330 |
| 167410 | Rhabdomyosarcoma, alveolar, 268220 |
| 167415 | Hypothyroidism, congenital, due to thyroid dysgenesis or hypoplasia |
| 168000 | Paraganglioma, familial nonchromaffin, 1 |
| 168360 | Paraneoplastic sensory neuropathy |
| 168450 | Hypoparathyroidism, autosomal dominant |
| 168450 | Hypoparathyroidism, autosomal recessive |
| 168461 | Multiple myeloma, 254250 |
| 168461 | Parathyroid adenomatosis 1 |
| 168461 | Centrocytic lymphoma |
| 168468 | Metaphyseal chondrodysplasia, Murk Jansen type, 156400 |
| 168470 | Humoral hypercalcemia of malignancy |
| 168500 | Parietal foramina |
| 169600 | Hailey-Hailey disease |
| 170261 | Bare lymphocyte syndrome, type I, due to TAP2 deficiency |
| 170500 | Myotonia congenita, atypical acetazolamide-responsive |
| 170500 | Paramyotonia congenita, 168300 |
| 170500 | Hyperkalemic periodic paralysis |
| 170650 | Periodontitis, juvenile |
| 170995 | Zellweger syndrome-2 |
| 171190 | Hypertension, essential, 145500 |
| 171650 | Lysosomal acid phosphatase deficiency |
| 171760 | Hypophosphatasia, adult, 146300 |
| 171760 | Hypophosphatasia, infantile, 241500 |
| 171860 | Hemolytic anemia due to phosphofructokinase deficiency |
| 172400 | Hemolytic anemia due to glucosephosphate isomerase deficiency |
| 172400 | Hydrops fetalis, one form |
| 172411 | Colorectal cancer, resistance to |
| 172430 | Enolase deficiency |
| 172471 | Glycogenosis, hepatic, autosomal |
| 172490 | Phosphorylase kinase deficiency of liver and muscle, 261750 |
| 173110 | Pituitary hormone deficiency, combined |
| 173350 | Plasminogen Tochigi disease |
| 173350 | Plasminogen deficiency, types I and II |
| 173350 | Thrombophilia, dysplasminogenemic |
| 173360 | Thrombophilia due to excessive plasminogen activator inhibitor |
| 173360 | Hemorrhagic diathesis due to PAI1 deficiency |
| 173370 | Plasminogen activator deficiency |
| 173470 | Glanzmann thrombasthenia, type B |
| 173610 | Platelet alpha/delta storage pool deficiency |
| 173850 | Polio, susceptibility to |
| 173870 | Xeroderma pigmentosum |
| 173870 | Fanconi anemia |
| 173910 | Polycystic kidney disease, adult, type II |
| 174000 | Medullary cystic kidney disease, AD |
| 174810 | Osteolysis, familial expansile |

TABLE 5-continued

| OMIM Reference | Description |
|---|---|
| 174900 | Polyposis, juvenile intestinal |
| 175100 | Turcot syndrome, 276300 |
| 175100 | Adenomatous polyposis coli |
| 175100 | Adenomatous polyposis coli, attenuated |
| 175100 | Colorectal cancer |
| 175100 | Desmoid disease, hereditary, 135290 |
| 175100 | Gardner syndrome |
| 176000 | Porphyria, acute intermittent |
| 176100 | Porphyria cutanea tarda |
| 176100 | Porphyria, hepatoerythropoietic |
| 176260 | Episodic ataxia/myokymia syndrome, 160120 |
| 176261 | Jervell and Lange-Nielsen syndrome, 220400 |
| 176270 | Prader-Willi syndrome |
| 176300 | [Dystransthyretinemic hyperthyroxinemia] |
| 176300 | Carpal tunnel syndrome, familial |
| 176300 | Amyloid neuropathy, familial, several allelic types |
| 176300 | Amyloidosis, senile systemic |
| 176310 | Leukemia, acute pre-B-cell |
| 176450 | Sacral agenesis-1 |
| 176640 | Creutzfeldt-Jakob disease, 123400 |
| 176640 | Gerstmann-Straussler disease, 137440 |
| 176640 | Insomnia, fatal familial |
| 176730 | Diabetes mellitus, rare form |
| 176730 | Hyperproinsulinemia, familial |
| 176730 | MODY, one form |
| 176801 | Metachromatic leukodystrophy due to deficiency of SAP-1 |
| 176801 | Gaucher disease, variant form |
| 176830 | Obesity, adrenal insufficiency, and red hair |
| 176830 | ACTH deficiency |
| 176880 | Protein S deficiency |
| 176930 | Dysprothrombinemia |
| 176930 | Hypoprothrombinemia |
| 176943 | Apert syndrome, 101200 |
| 176943 | Pfeiffer syndrome, 101600 |
| 176943 | Beare-Stevenson cutis gyrata syndrome, 123790 |
| 176943 | Crouzon craniofacial dysostosis, 123500 |
| 176943 | Jackson-Weiss syndrome, 123150 |
| 176960 | Pituitary tumor, invasive |
| 177400 | Apnea, postanesthetic |
| 177900 | Psoriasis susceptibility-1 |
| 178300 | Ptosis, hereditary congenital, 1 |
| 178600 | Pulmonary hypertension, familial primary |
| 178640 | Pulmonary alveolar proteinosis, congenital, 265120 |
| 179095 | Male infertility |
| 179450 | Ragweed sensitivity |
| 179605 | Retinitis pigmentosa, digenic |
| 179605 | Retinitis pigmentosa-7, peripherin-related |
| 179605 | Retinitis punctata albescens |
| 179605 | Butterfly dystrophy, retinal |
| 179605 | Macular dystrophy |
| 179615 | Reticulosis, familial histiocytic, 267700 |
| 179615 | Severe combined immunodeficiency, B cell-negative, 601457 |
| 179616 | Severe combined immunodeficiency, B cell-negative, 601457 |
| 179755 | Renal cell carcinoma, papillary, 1 |
| 179820 | [Hyperproreninemia] |
| 180020 | Retinal cone dystrophy-1 |
| 180069 | Retinal dystrophy, autosomal recessive, childhood-onset |
| 180069 | Retinitis pigmentosa-20 |
| 180069 | Leber congenital amaurosis-2, 204100 |
| 180071 | Retinitis pigmentosa, autosomal recessive |
| 180072 | Night blindness, congenital stationary, type 3, 163500 |
| 180072 | Retinitis pigmentosa, autosomal recessive |
| 180090 | Retinitis pigmentosa, autosomal recessive |
| 180100 | Retinitis pigmentosa-1 |
| 180104 | Retinitis pigmentosa-9 |
| 180105 | Retinitis pigmentosa-10 |
| 180200 | Osteosarcoma, 259500 |
| 180200 | Pinealoma with bilateral retinoblastoma |
| 180200 | Retinoblastoma |
| 180200 | Bladder cancer, 109800 |
| 180240 | Leukemia, acute promyelocytic |
| 180250 | Retinol binding protein, deficiency of |
| 180297 | Anemia, hemolytic, Rh-null, suppressor type, 268150 |
| 180380 | Night blindness, congenital stationery, rhodopsin-related |
| 180380 | Retinitis pigmentosa, autosomal recessive |
| 180380 | Retinitis pigmentosa-4, autosomal dominant |
| 180381 | Oguchi disease-2, 258100 |
| 180385 | Leukemia, acute T-cell |
| 180721 | Retinitis pigmentosa, digenic |
| 180840 | Susceptibility to IDDM |
| 180860 | Russell-Silver syndrome |
| 180901 | Malignant hyperthermia susceptibility 1, 145600 |
| 180901 | Central core disease, 117000 |
| 181405 | Scapuloperoneal spinal muscular atrophy, New England type |
| 181430 | Scapuloperoneal syndrome, myopathic type |
| 181460 | Schistosoma mansoni, susceptibility/resistance to |
| 181510 | Schizophrenia |
| 181600 | Sclerotylosis |
| 182138 | Anxiety-related personality traits |
| 182279 | Prader-Willi syndrome |
| 182280 | Small-cell cancer of lung |
| 182290 | Smith-Magenis syndrome |
| 182380 | Glucose/galactose malabsorption |
| 182381 | Renal glucosuria, 253100 |
| 182452 | Lung cancer, small cell |
| 182600 | Spastic paraplegia-3A |
| 182601 | Spastic paraplegia-4 |
| 182860 | Pyropoikilocytosis |
| 182860 | Spherocytosis, recessive |
| 182860 | Elliptocytosis-2 |
| 182870 | Spherocytosis-1 |
| 182870 | Elliptocytosis-3 |
| 182870 | Anemia, neonatal hemolytic, fatal and near-fatal |
| 182900 | Spherocytosis-2 |
| 185000 | Stomatocytosis I |
| 185430 | Atherosclerosis, susceptibility to |
| 185470 | Myopathy due to succinate dehydrogenase deficiency |
| 185800 | Symphalangism, proximal |
| 186580 | Arthrocutaneouveal granulomatosis |
| 186740 | Immunodeficiency due to defect in CD3-gamma |
| 186770 | Leukemia, T-cell acute lymphocytic |
| 186780 | CD3, zeta chain, deficiency |
| 186830 | Immunodeficiency, T-cell receptor/CD3 complex |
| 186855 | Leukemia-2, T-cell acute lymphoblastic |
| 186860 | Leukemia/lymphoma, T-cell |
| 186880 | Leukemia/lymphoma, T-cell |
| 186921 | Leukemia, T-cell acute lymphoblastic |
| 186940 | [CD4(+) lymphocyte deficiency] |
| 186940 | Lupus erythematosus, susceptibility to |
| 187040 | Leukemia-1, T-cell acute lymphoblastic |
| 187680 | 6-mercaptopurine sensitivity |
| 188025 | Thrombocytopenia, Paris-Trousseau type |
| 188070 | Bleeding disorder due to defective thromboxane A2 receptor |
| 188400 | Velocardiofacial syndrome, 192430 |
| 188400 | DiGeorge syndrome |
| 188450 | Goiter, adolescent multinodular |
| 188450 | Goiter, nonendemic, simple |
| 188450 | Hypothyroidism, hereditary congenital |
| 188550 | Thyroid papillary carcinoma |
| 188826 | Sorsby fundus dystrophy, 136900 |
| 189800 | Preeclampsia/eclampsia |
| 189980 | Leukemia, chronic myeloid |
| 190000 | Atransferrinemia |
| 190020 | Bladder cancer, 109800 |
| 190040 | Meningioma, SIS-related |
| 190040 | Dermatofibrosarcoma protuberans |
| 190040 | Giant-cell fibroblastoma |
| 190070 | Colorectal adenoma |
| 190070 | Colorectal cancer |
| 190100 | Geniospasm |
| 190160 | Thyroid hormone resistance, 274300, 188570 |
| 190182 | Colon cancer |
| 190182 | Colorectal cancer, familial nonpolyposis, type 6 |
| 190195 | Ichthyosiform erythroderma, congenital, 242100 |
| 190195 | Ichthyosis, lamellar, autosomal recessive, 242300 |
| 190198 | Leukemia, T-cell acute lymphoblastic |
| 190300 | Tremor, familial essential, 1 |
| 190450 | Hemolytic anemia due to triosephosphate isomerase deficiency |
| 190605 | Triphalangeal thumb-polysyndactyly syndrome |
| 190685 | Down syndrome |
| 190900 | Colorblindness, tritan |

TABLE 5-continued

| OMIM Reference | Description |
|---|---|
| 191030 | Nemaline myopathy-1, 161800 |
| 191044 | Cardiomyopathy, familial hypertrophic |
| 191045 | Cardiomyopathy, familial hypertrophic, 2, 115195 |
| 191092 | Tuberous sclerosis-2 |
| 191100 | Tuberous sclerosis-1 |
| 191181 | Cervical carcinoma |
| 191290 | Segawa syndrome, recessive |
| 191315 | Insensitivity to pain, congenital, with anhidrosis, 256800 |
| 191540 | [Urate oxidase deficiency] |
| 192090 | Ovarian carcinoma |
| 192090 | Breast cancer, lobular |
| 192090 | Endometrial carcinoma |
| 192090 | Gastric cancer, familial, 137215 |
| 192340 | Diabetes insipidus, neurohypophyseal, 125700 |
| 192500 | Jervell and Lange-Nielsen syndrome, 220400 |
| 192500 | Long QT syndrome-1 |
| 192974 | Neonatal alloimmune thrombocytopenia |
| 192974 | Glycoprotein Ia deficiency |
| 193100 | Hypophosphatemic rickets, autosomal dominant |
| 193235 | Vitreoretinopathy, neovascular inflammatory |
| 193300 | Renal cell carcinoma |
| 193300 | von Hippel-Lindau syndrome |
| 193400 | von Willebrand disease |
| 193500 | Rhabdomyosarcoma, alveolar, 268220 |
| 193500 | Waardenburg syndrome, type I |
| 193500 | Waardenburg syndrome, type III, 148820 |
| 193500 | Craniofacial-deafness-hand syndrome, 122880 |
| 194070 | Wilms tumor, type 1 |
| 194070 | Denys-Drash syndrome |
| 194070 | Frasier syndrome, 136680 |
| 194071 | Wilms tumor, type 2 |
| 194071 | Adrenocortical carcinoma, hereditary, 202300 |
| 194190 | Wolf-Hirschhorn syndrome |
| 200990 | Acrocallosal syndrome |
| 201450 | Acyl-CoA dehydrogenase, medium chain, deficiency of |
| 201460 | Acyl-CoA dehydrogenase, long chain, deficiency of |
| 201470 | Acyl-CoA dehydrogenase, short-chain, deficiency of |
| 201475 | VLCAD deficiency |
| 201810 | 3-beta-hydroxysteroid dehydrogenase, type II, deficiency |
| 201910 | Adrenal hyperplasia, congenital, due to 21-hydroxylase deficiency |
| 202110 | Adrenal hyperplasia, congenital, due to 17-alpha-hydroxylase deficiency |
| 203100 | Waardenburg syndrome/ocular albinism, digenic, 103470 |
| 203100 | Albinism, oculocutaneous, type IA |
| 203200 | Albinism, ocular, autosomal recessive |
| 203200 | Albinism, oculocutaneous, type II |
| 203300 | Hermansky-Pudlak syndrome |
| 203310 | Ocular albinism, autosomal recessive |
| 203500 | Alkaptonuria |
| 203740 | Alpha-ketoglutarate dehydrogenase deficiency |
| 203750 | 3-ketothiolase deficiency |
| 203800 | Alstrom syndrome |
| 204500 | Ceroid-lipofuscinosis, neuronal 2, classic late infantile |
| 205100 | Amyotrophic lateral sclerosis, juvenile |
| 205900 | Anemia, Diamond-Blackfan |
| 207750 | Hyperlipoproteinemia, type Ib |
| 208100 | Arthrogryposis multiplex congenita, neurogenic |
| 208250 | Jacobs syndrome |
| 208400 | Aspartylglucosaminuria |
| 208900 | Ataxia-telangiectasia |
| 208900 | B-cell non-Hodgkin lymphoma, sporadic |
| 208900 | T-cell prolymphocytic leukemia, sporadic |
| 209900 | Bardet-Biedl syndrome 2 |
| 209901 | Bardet-Biedl syndrome 1 |
| 210900 | Bloom syndrome |
| 211420 | Breast cancer, ductal |
| 212138 | Carnitine-acylcarnitine translocase deficiency |
| 214300 | Klippel-Feil syndrome |
| 214500 | Chediak-Higashi syndrome |
| 215700 | Citrullinemia |
| 216550 | Cohen syndrome |
| 216900 | Achromatopsia |
| 216950 | C1r/C1s deficiency, combined |
| 217000 | C2 deficiency |
| 217030 | C3b inactivator deficiency |
| 217095 | Conotruncal cardiac anomalies |
| 217300 | Cornea plana congenita, recessive |
| 217800 | Macular corneal dystrophy |
| 218000 | Andermann syndrome |
| 218030 | Apparent mineralocorticoid excess, hypertension due to |
| 219800 | Cystinosis, nephropathic |
| 221770 | Polycystic lipomembranous osteodysplasia with sclerosing leukencephalopathy |
| 221820 | Gliosis, familial progressive subcortical |
| 222100 | Diabetes mellitus, insulin-dependent-1 |
| 222600 | Atelosteogenesis II, 256050 |
| 222600 | Achondrogenesis Ib, 600972 |
| 222600 | Diastrophic dysplasia |
| 222700 | Lysinuric protein intolerance |
| 222745 | DECR deficiency |
| 222800 | Hemolytic anemia due to bisphosphoglycerate mutase deficiency |
| 222900 | Sucrose intolerance |
| 223360 | Dopamine-beta-hydroxylase deficiency |
| 223900 | Dysautonomia, familial |
| 224100 | Congenital dyserythropoietic anemia II |
| 224120 | Dyserythropoietic anemia, contenital, type I |
| 225500 | Ellis-van Creveld syndrome |
| 226450 | Epidermolysis bullosa inversa, junctional |
| 227220 | [Eye color, brown] |
| 227400 | Thromboembolism susceptibility due to factor V Leiden |
| 227400 | Hemorrhagic diathesis due to factor V deficiency |
| 227500 | Factor VII deficiency |
| 227600 | Factor X deficiency |
| 227645 | Fanconi anemia, type C |
| 227646 | Fanconi anemia, type D |
| 227650 | Fanconi anemia, type A |
| 228960 | [Kininogen deficiency] |
| 229300 | Friedreich ataxia |
| 229300 | Friedreich ataxia with retained reflexes |
| 229600 | Fructose intolerance |
| 229700 | Fructose-bisphosphatase deficiency |
| 229800 | [Fructosuria] |
| 230000 | Fucosidosis |
| 230200 | Galactokinase deficiency with cataracts |
| 230350 | Galactose epimerase deficiency |
| 230400 | Galactosemia |
| 230800 | Gaucher disease |
| 230800 | Gaucher disease with cardiovascular calcification |
| 231550 | Achalasia-addisonianism-alacrimia syndrome |
| 231670 | Glutaricaciduria, type I |
| 231675 | Glutaricaciduria, type IIC |
| 231680 | Glutaricaciduria, type IIA |
| 232000 | Propionicacidemia, type I or pccA type |
| 232050 | Propionicacidemia, type II or pccB type |
| 232300 | Glycogen storage disease II |
| 232500 | Glycogen storage disease IV |
| 232600 | McArdle disease |
| 232700 | Glycogen storage disease VI |
| 232800 | Glycogen storage disease VII |
| 233100 | [Renal glucosuria] |
| 233700 | Chronic granulomatous disease due to deficiency of NCF-1 |
| 233710 | Chronic granulomatous disease due to deficiency of NCF-2 |
| 234200 | Neurodegeneration with brain iron accumulation |
| 235200 | Hemochromatosis |
| 235800 | [Histidinemia] |
| 236100 | Holoprosencephaly-1 |
| 236200 | Homocystinuria, B6-responsive and nonresponsive types |
| 236250 | Homocystinuria due to MTHFR deficiency |
| 236700 | McKusick-Kaufman syndrome |
| 236730 | Urofacial syndrome |
| 237300 | Carbamoylphosphate synthetase I deficiency |
| 238310 | Hyperglycinemia, nonketotic, type II |
| 238600 | Chylomicronemia syndrome, familial |
| 238600 | Combined hyperlipemia, familial |
| 238600 | Hyperlipoproteinemia I |
| 238600 | Lipoprotein lipase deficiency |
| 238970 | HHH syndrome |
| 239100 | Van Buchem disease |
| 240300 | Autoimmune polyglandular disease, type I |
| 240400 | Scurvy |

TABLE 5-continued

| OMIM Reference | Description |
|---|---|
| 243500 | Isovalericacidemia |
| 245000 | Papillon-Lefevre syndrome |
| 245200 | Krabbe disease |
| 245349 | Lacticacidemia due to PDX1 deficiency |
| 245900 | Norum disease |
| 245900 | Fish-eye disease |
| 246450 | HMG-CoA lyase deficiency |
| 246530 | Leukotriene C4 synthase deficiency |
| 246900 | Lipoamide dehydrogenase deficiency |
| 247200 | Miller-Dieker lissencephaly syndrome |
| 247640 | Leukemia, acute lymphoblastic |
| 248510 | Mannosidosis, beta- |
| 248600 | Maple syrup urine disease, type Ia |
| 248610 | Maple syrup urine disease, type II |
| 248611 | Maple syrup urine disease, type Ib |
| 249000 | Meckel syndrome |
| 249100 | Familial Mediterranean fever |
| 249270 | Thiamine-responsive megaloblastic anemia |
| 250100 | Metachromatic leukodystrophy |
| 250250 | Cartilage-hair hypoplasia |
| 250790 | Methemoglobinemia due to cytochrome b5 deficiency |
| 250800 | Methemoglobinemia, type I |
| 250800 | Methemoglobinemia, type II |
| 250850 | Hypermethioninemia, persistent, autosomal dominant, due to methionine adenosyltransferase I/III deficiency |
| 251170 | Mevalonicaciduria |
| 251600 | Microphthalmia, autosomal recessive |
| 252500 | Mucolipidosis II |
| 252500 | Mucolipidosis III |
| 252800 | Mucopolysaccharidosis Ih |
| 252800 | Mucopolysaccharidosis Ih/s |
| 252800 | Mucopolysaccharidosis Is |
| 252900 | Sanfilippo syndrome, type A |
| 253000 | Mucopolysaccharidosis IVA |
| 253200 | Maroteaux-Lamy syndrome, several forms |
| 253250 | Mulibrey nanism |
| 253601 | Miyoshi myopathy, 254130 |
| 253601 | Muscular dystrophy, limb-girdle, type 2B |
| 253700 | Muscular dystrophy, limb-girdle, type 2C |
| 253800 | Walker-Warburg syndrome, 236670 |
| 253800 | Fukuyama type congenital muscular dystrophy |
| 254210 | Myasthenia gravis, familial infantile |
| 254770 | Epilepsy, juvenile myoclonic |
| 255800 | Schwartz-Jampel syndrome |
| 256030 | Nemaline myopathy-2 |
| 256540 | Galactosialidosis |
| 256550 | Sialidosis, type I |
| 256550 | Sialidosis, type II |
| 256700 | Neuroblastoma |
| 256731 | Ceroid-lipofuscinosis, neuronal-5, variant late infantile |
| 257200 | Niemann-Pick disease, type A |
| 257200 | Niemann-Pick disease, type B |
| 257220 | Niemann-Pick disease, type C |
| 257220 | Niemann-Pick disease, type D, 257250 |
| 258501 | 3-methylglutaconicaciduria, type III |
| 258870 | Gyrate atrophy of choroid and retina with ornithinemia, B6 responsive or unresponsive |
| 258900 | Oroticaciduria |
| 259700 | Osteopetrosis, recessive |
| 259730 | Renal tubular acidosis-osteopetrosis syndrome |
| 259770 | Osteoporosis-pseudoglioma syndrome |
| 259900 | Hyperoxaluria, primary, type 1 |
| 261510 | Pseudo-Zellweger syndrome |
| 261515 | Peroxisomal bifunctional enzyme deficiency |
| 261600 | Phenylketonuria |
| 261600 | [Hyperphenylalaninemia, mild] |
| 261640 | Phenylketonuria due to PTS deficiency |
| 261670 | Myopathy due to phosphoglycerate mutase deficiency |
| 262000 | Bjornstad syndrome |
| 263200 | Polycystic kidney disease, autosomal recessive |
| 263700 | Porphyria, congenital erythropoietic |
| 264300 | Pseudohermaphroditism, male, with gynecomastia |
| 264470 | Adrenoleukodystrophy, pseudoneonatal |
| 266150 | Pyruvate carboxylase deficiency |
| 266200 | Anemia, hemolytic, due to PK deficiency |
| 266300 | [Hair color, red] |
| 266600 | Inflammatory bowel disease-1 |
| 267750 | Knobloch syndrome |
| 268800 | Sandhoff disease, infantile, juvenile, and adult forms |
| 268800 | Spinal muscular atrophy, HEXB-related |
| 268900 | [Sarcosinemia] |
| 269920 | Salla disease |
| 270100 | Situs inversus viscerum |
| 270200 | Sjogren-Larsson syndrome |
| 270800 | Spastic paraplegia-5A |
| 271245 | Spinocerebellar ataxia-8, infantile, with sensory neuropathy |
| 271900 | Canavan disease |
| 272750 | GM2-gangliosidosis, AB variant |
| 272800 | Tay-Sachs disease |
| 272800 | [Hex A pseudodeficiency] |
| 272800 | GM2-gangliosidosis, juvenile, adult |
| 273300 | Male germ cell tumor |
| 273800 | Thrombocytopenia, neonatal alloimmune |
| 273800 | Glanzmann thrombasthenia, type A |
| 274180 | Thromboxane synthase deficiency |
| 274270 | Thymine-uraciluria |
| 274270 | Fluorouracil toxicity, sensitivity to |
| 275200 | Thyroid adenoma, hyperfunctioning |
| 275200 | Graves disease, 275000 |
| 275200 | Hyperthroidism, congenital |
| 275200 | Hypothyroidism, nongoitrous, due to TSH resistance |
| 276600 | Tyrosinemia, type II |
| 276700 | Tyrosinemia, type I |
| 276710 | Tyrosinemia, type III |
| 276900 | Usher syndrome, type 1A |
| 276901 | Usher syndrome, type 2 |
| 276902 | Usher syndrome, type 3 |
| 276903 | Usher syndrome, type 1B |
| 276903 | Deafness, autosomal dominant 11, neurosensory, 601317 |
| 276903 | Deafness, autosomal recessive 2, neurosensory, 600060 |
| 276904 | Usher syndrome, type 1C |
| 277700 | Werner syndrome |
| 277730 | Wernicke-Korsakoff syndrome, susceptibility to |
| 277900 | Wilson disease |
| 278000 | Wolman disease |
| 278000 | Cholesteryl ester storage disease |
| 278300 | Xanthinuria, type I |
| 278700 | Xeroderma pigmentosum, group A |
| 278760 | Xeroderma pigmentosum, group F |
| 300000 | Opitz G syndrome, type I |
| 300008 | Nephrolithiasis, type I, 310468 |
| 300008 | Proteinuria, low molecular weight, with hypercalciuric nephrocalcinosis |
| 300008 | Dent disease, 300009 |
| 300008 | Hypophosphatemia, type III |
| 300011 | Menkes disease, 309400 |
| 300011 | Occipital horn syndrome, 304150 |
| 300011 | Cutis laxa, neonatal |
| 300031 | Mental retardation, X-linked, FRAXF type |
| 300037 | Simpson dysmorphia syndrome, 312870 |
| 300044 | Wernicke-Korsakoff syndrome, susceptibility to |
| 300046 | Mental retardation, X-linked 23, nonspecific |
| 300047 | Mental retardation, X-linked 20 |
| 300048 | Intestinal pseudoobstruction, neuronal, X-linked |
| 300049 | Nodular heterotopia, bilateral periventricular |
| 300049 | BPNH/MR syndrome |
| 300055 | Mental retardation with psychosis, pyramidal signs, and macroorchidism |
| 300062 | Mental retardation, X-linked 14 |
| 300066 | Deafness, X-linked 6, sensorineural |
| 300067 | Subcortical laminar heterotopia, X-linked dominant |
| 300067 | Lissencephaly, X-linked |
| 300071 | Night blindness, congenital stationary, type 2 |
| 300075 | Coffin-Lowry syndrome, 303600 |
| 300076 | Wood neuroimmunologic syndrome |
| 300077 | Mental retardation, X-linked 29 |
| 300100 | Adrenoleukodystrophy |
| 300100 | Adrenomyeloneuropathy |
| 300104 | Mental retardation, X-linked nonspecific, 309541 |
| 300110 | Night blindness, congenital stationary, X-linked incomplete, 300071 |
| 300121 | Subcortical laminal heteropia, X-linked, 300067 |

TABLE 5-continued

| OMIM Reference | Description |
|---|---|
| 300121 | Lissencephaly, X-linked, 300067 |
| 300123 | Mental retardation with isolated growth hormone deficiency |
| 300126 | Dyskeratosis congenita-1, 305000 |
| 300127 | Mental retardation, X-linked, 60 |
| 300136 | Diabetes mellitus, insulin-dependent, X-linked, susceptibility to |
| 300300 | XLA and isolated growth hormone deficiency, 307200 |
| 300300 | Agammaglobulinemia, type 1, X-linked |
| 300310 | Agammaglobulinemia, type 2, X-linked |
| 300500 | Ocular albinism, Nettleship-Falls type |
| 300600 | Ocular albinism, Forsius-Eriksson type |
| 300650 | Ocular albinism with sensorineural deafness |
| 301000 | Thrombocytopenia, X-linked, 313900 |
| 301000 | Wiskott-Aldrich syndrome |
| 301200 | Amelogenesis imperfecta |
| 301201 | Amelogenesis imperfecta-3, hypoplastic type |
| 301220 | Partington syndrome II |
| 301590 | Anophthalmos-1 |
| 301830 | Arthrogryposis, X-linked (spinal muscular atrophy, infantile, X-linked) |
| 301835 | Arts syndrome |
| 301845 | Bazex syndrome |
| 301900 | Borjeson-Forssman-Lehmann syndrome |
| 302060 | Noncompaction of left ventricular myocardium, isolated |
| 302060 | Barth syndrome |
| 302060 | Cardiomyopathy, X-linked dilated, 300069 |
| 302060 | Endocardial fibroelastosis-2 |
| 302350 | Nance-Horan syndrome |
| 302801 | Charcot-Marie-Tooth neuropathy, X-linked-2, recessive |
| 302950 | Chondrodysplasia punctata, X-linked recessive, 302940 |
| 302960 | Chondrodysplasia punctata, X-linked dominant |
| 303700 | Colorblindness, blue monochromatic |
| 303800 | Colorblindness, deutan |
| 303900 | Colorblindness, protan |
| 304020 | Cone dystrophy, progressive X-linked, 1 |
| 304040 | Charcot-Marie-Tooth neuropathy, X-linked-1, dominant, 302800 |
| 304050 | Aicardi syndrome |
| 304110 | Craniofrontonasal dysplasia |
| 304340 | Mental retardation, X-linked, syndromic-5, with Dandy-Walker malformation, basal ganglia disease, and seizures |
| 304800 | Diabetes insipidus, nephrogenic |
| 305100 | Anhidrotic ectodermal dysplasia |
| 305435 | Heterocellular hereditary persistence of fetal hemoglobin, Swiss type |
| 305450 | FG syndrome |
| 305900 | Favism |
| 305900 | G6PD deficiency |
| 305900 | Hemolytic anemia due to G6PD deficiency |
| 306000 | Glycogenosis, X-linked hepatic, type I |
| 306000 | Glycogenosis, X-linked hepatic, type II |
| 306100 | Gonadal dysgenesis, XY female type |
| 306400 | Chronic granulomatous disease, X-linked |
| 306700 | Hemophilia A |
| 306995 | [Homosexuality, male] |
| 307150 | Hypertrichosis, congenital generalized |
| 307700 | Hypoparathyroidism, X-linked |
| 307800 | Hypophosphatemia, hereditary |
| 308000 | HPRT-related gout |
| 308000 | Lesch-Nyhan syndrome |
| 308230 | Immunodeficiency, X-linked, with hyper-IgM |
| 308240 | Lymphoproliferative syndrome, X-linked |
| 308310 | Incontinentia pigmenti, familial |
| 308700 | Kallmann syndrome |
| 308800 | Keratosis follicularis spinulosa decalvans |
| 308840 | Spastic paraplegia, 312900 |
| 308840 | Hydrocephalus due to aqueductal stenosis, 307000 |
| 308840 | MASA syndrome, 303350 |
| 309000 | Lowe syndrome |
| 309200 | Manic-depressive illness, X-linked |
| 309300 | Megalocornea, X-linked |
| 309470 | Mental retardation, X-linked, syndromic-3, with spastic diplegia |
| 309500 | Renpenning syndrome-1 |
| 309510 | Mental retardation, X-linked, syndromic-1, with dystonic movements, ataxia, and seizures |
| 309530 | Mental retardation, X-linked 1, non-dysmorphic |
| 309545 | Mental retardation, X-linked nonspecific, with aphasia |
| 309548 | Mental retardation, X-linked, FRAXE type |
| 309555 | Gustavson syndrome |
| 309585 | Mental retardation, X-linked, syndromic-6, with gynecomastia and obesity |
| 309600 | Allan-Herndon syndrome |
| 309605 | Mental retardation, X-linked, syndromic-4, with congenital contractures and low fingertip arches |
| 309610 | Mental retardation, X-linked, syndromic-2, with dysmorphism and cerebral atrophy |
| 309620 | Mental retardation-skeletal dysplasia |
| 309850 | Brunner syndrome |
| 309900 | Mucopolysaccharidosis II |
| 310300 | Emery-Dreifuss muscular dystrophy |
| 310400 | Myotubular myopathy, X-linked |
| 310460 | Myopia-1 |
| 310460 | Bornholm eye disease |
| 310490 | Cowchock syndrome |
| 310500 | Night blindness, congenital stationary, type 1 |
| 311050 | Optic atrophy, X-linked |
| 311200 | Oral-facial-digital syndrome 1 |
| 311250 | Ornithine transcarbamylase deficiency |
| 311300 | Otopalatodigital syndrome, type I |
| 311360 | Ovarian failure, premature |
| 311510 | Waisman parkinsonism-mental retardation syndrome |
| 311850 | Phosphoribosyl pyrophosphate synthetase-related gout |
| 312000 | Panhypopituitarism, X-linked |
| 312040 | N syndrome, 310465 |
| 312060 | Properdin deficiency, X-linked |
| 312170 | Pyruvate dehydrogenase deficiency |
| 312600 | Retinitis pigmentosa-2 |
| 312610 | Retinitis pigmentosa-3 |
| 312700 | Retinoschisis |
| 312760 | Turner syndrome |
| 313350 | Split hand/foot malformation, type 2 |
| 313400 | Spondyloepiphyseal dysplasia tarda |
| 313700 | Perineal hypospadias |
| 313700 | Prostate cancer |
| 313700 | Spinal and bulbar muscular atrophy of Kennedy, 313200 |
| 313700 | Breast cancer, male, with Reifenstein syndrome |
| 313700 | Androgen insensitivity, several forms |
| 313850 | Thoracoabdominal syndrome |
| 314250 | Dystonia-3, torsion, with parkinsonism, Filipino type |
| 314300 | Goeminne TKCR syndrome |
| 314400 | Cardiac valvular dysplasia-1 |
| 314580 | Wieacker-Wolff syndrome |
| 314850 | McLeod phenotype |
| 600040 | Colorectal cancer |
| 600044 | Thrombocythemia, essential, 187950 |
| 600045 | Xeroderma pigmentosum, group E, subtype 2 |
| 600048 | Breast cancer-3 |
| 600059 | Retinitis pigmentosa-13 |
| 600065 | Leukocyte adhesion deficiency, 116920 |
| 600079 | Colon cancer |
| 600095 | Split hand/foot malformation, type 3 |
| 600101 | Deafness, autosomal dominant 2 |
| 600105 | Retinitis pigmentosa-12, autosomal recessive |
| 600119 | Muscular dystrophy, Duchenne-like, type 2 |
| 600119 | Adhalinopathy, primary |
| 600138 | Retinitis pigmentosa-11 |
| 600140 | Rubenstein-Taybi syndrome, 180849 |
| 600143 | Epilepsy, progressive, with mental retardation |
| 600151 | Bardet-Biedl syndrome 3 |
| 600160 | Melanoma, 155601 |
| 600163 | Long QT syndrome-3 |
| 600173 | SCID, autosomal recessive, T-negative/B-positive type |
| 600175 | Spinal muscular atrophy, congenital nonprogressive, of lower limbs |
| 600179 | Leber congenital amaurosis, type I, 204000 |
| 600184 | Carnitine acetyltransferase deficiency |
| 600194 | Ichthyosis bullosa of Siemens, 146800 |
| 600202 | Dyslexia, specific, 2 |

TABLE 5-continued

| OMIM Reference | Description |
|---|---|
| 600221 | Venous malformations, multiple cutaneous and mucosal, 600195 |
| 600223 | Spinocerebellar ataxia-4 |
| 600225 | Phenylketonuria, atypical, due to GCH1 deficiency, 233910 |
| 600225 | Dystonia, DOPA-responsive, 128230 |
| 600228 | Pseudohypoaldosteronism, type I, 264350 |
| 600231 | Palmoplantar keratoderma, Bothnia type |
| 600234 | HMG-CoA synthease-2 deficiency |
| 600243 | Temperature-sensitive apoptosis |
| 600258 | Colorectal cancer, hereditary nonpolyposis, type 3 |
| 600259 | Turcot syndrome with glioblastoma, 276300 |
| 600259 | Colorectal cancer, hereditary nonpolyposis, type 4 |
| 600261 | Ehlers-Danlos-like syndrome |
| 600266 | Resistance/susceptibility to TB, etc. |
| 600273 | Polycystic kidney disease, infantile severe, with tuberous sclerosis |
| 600276 | Cerebral arteriopathy with subcortical infarcts and leukoencephalopathy, 125310 |
| 600281 | Non-insulin-dependent diabetes mellitus, 125853 |
| 600281 | MODY, type 1, 125850 |
| 600309 | Atrioventricular canal defect-1 |
| 600310 | Pseudoachondroplasia, 177170 |
| 600310 | Epiphyseal dysplasia, multiple 1, 132400 |
| 600318 | Diabetes mellitus, insulin-dependent, 3 |
| 600319 | Diabetes mellitus, insulin-dependent, 4 |
| 600320 | Insulin-dependent diabetes mellitus-5 |
| 600332 | Rippling muscle disease-1 |
| 600354 | Spinal muscular atrophy-1, 253300 |
| 600354 | Spinal muscular atrophy-2, 253550 |
| 600354 | Spinal muscular atrophy-3, 253400 |
| 600359 | Bartter syndrome, type 2 |
| 600363 | Spastic paraplegia-6 |
| 600364 | Cone dystrophy-3, 602093 |
| 600374 | Bardet-Biedl syndrome 4 |
| 600414 | Adrenoleukodystrophy, neonatal, 202370 |
| 600509 | Persistent hyperinsulinemic hypoglycemia of infancy, 256450 |
| 600510 | Pigment dispersion syndrome |
| 600511 | Schizophrenia-3 |
| 600512 | Epilepsy, partial |
| 600525 | Trichodontoosseous syndrome, 190320 |
| 600528 | CPT deficiency, hepatic, type I, 255120 |
| 600536 | Myopathy, congenital |
| 600542 | Chondrosarcoma, extraskeletal myxoid |
| 600584 | Atrial septal defect with atrioventricular conduction defects, 108900 |
| 600593 | Craniosynostosis, Adelaide type |
| 600617 | Lipoid adrenal hyperplasia, 201710 |
| 600618 | Leukemia, acute lymphoblastic |
| 600623 | Prostate cancer, 176807 |
| 600631 | Enuresis, nocturnal, 1 |
| 600650 | Myopathy due to CPT II deficiency, 255110 |
| 600650 | CPT deficiency, hepatic, type II, 600649 |
| 600652 | Deafness, autosomal dominant 4 |
| 600669 | Epilepsy, generalized, idiopathic |
| 600678 | Cancer susceptibility |
| 600698 | Salivary adenoma |
| 600698 | Uterine leiomyoma |
| 600698 | Lipoma |
| 600698 | Lipomatosis, mutiple, 151900 |
| 600700 | Lipoma |
| 600722 | Ceroid lipofuscinosis, neuronal, variant juvenile type, with granular osmiophilic deposits |
| 600722 | Ceroid lipofuscinosis, neuronal-1, infantile, 256730 |
| 600725 | Holoprosencephaly-3, 142945 |
| 600757 | Orofacial cleft-3 |
| 600759 | Alzheimer disease-4 |
| 600760 | Pseudohypoaldosteronism, type I, 264350 |
| 600760 | Liddle syndrome, 177200 |
| 600761 | Pseudohypoaldosteronism, type I, 264350 |
| 600761 | Liddle syndrome, 177200 |
| 600792 | Deafness, autosomal recessive 5 |
| 600795 | Dementia, familial, nonspecific |
| 600807 | Bronchial asthma |
| 600808 | Enuresis, nocturnal, 2 |
| 600811 | Xeroderma pigmentosum, group E, DDB-negative subtype, 278740 |
| 600835 | AIDS, resistance to |
| 600837 | Hirschsprung disease, 142623 |
| 600839 | Bartter syndrome, 241200 |
| 600850 | Schizophrenia disorder-4 |
| 600852 | Retinitis pigmentosa-17 |
| 600856 | Beckwith-Wiedemann syndrome, 130650 |
| 600881 | Cataract, congenital, zonular, with sutural opacities |
| 600882 | Charcot-Marie-Tooth neuropathy-2B |
| 600883 | Diabetes mellitus, insulin-dependent, 8 |
| 600884 | Cardiomyopathy, familial dilated 1B |
| 600887 | Endometrial carcinoma |
| 600897 | Cataract, zonular pulverulent-1, 116200 |
| 600900 | Muscular dystrophy, limb-girdle, type 2E |
| 600918 | Cystinuria, type III |
| 600919 | Long QT syndrome-4 with sinus bradycardia |
| 600923 | Porphyria variegata, 176200 |
| 600937 | Persistent hyperinsulinemic hypoglycemia of infancy, 256450 |
| 600956 | Persistent Mullerian duct syndrome, type II, 261550 |
| 600957 | Persistent Mullerian duct syndrome, type I, 261550 |
| 600958 | Cardiomyopathy, familial hypertrophic, 4, 115197 |
| 600965 | Deafness, autosomal dominant 6 |
| 600968 | Gitelman syndrome, 263800 |
| 600971 | Deafness, autosomal recessive 6 |
| 600974 | Deafness, autosomal recessive 7 |
| 600975 | Glaucoma 3, primary infantile, B |
| 600977 | Cone dystrophy, progressive |
| 600994 | Deafness, autosomal dominant 5 |
| 600995 | Nephrotic syndrome, idiopathic, steroid-resistant |
| 600996 | Arrhythmogenic right ventricular dysplasia-2 |
| 601002 | 5-oxoprolinuria, 266130 |
| 601002 | Hemolytic anemia due to glutathione synthetase deficiency, 231900 |
| 601071 | Deafness, autosomal recessive 9 |
| 601072 | Deafness, autosomal recessive 8 |
| 601090 | Iridogoniodysgenesis, 601631 |
| 601097 | Neuropathy, recurrent, with pressure palsies, 162500 |
| 601097 | Charcot-Marie-Tooth neuropathy-1A, 118220 |
| 601097 | Dejerine-Sottas disease, PMP22 related, 145900 |
| 601105 | Pycnodysostosis, 265800 |
| 601107 | Dubin-Johnson syndrome, 237500 |
| 601130 | Tolbutamide poor metabolizer |
| 601145 | Epilepsy, progressive myoclonic 1, 254800 |
| 601146 | Brachydactyly, type C, 113100 |
| 601146 | Acromesomelic dysplasia, Hunter-Thompson type, 201250 |
| 601146 | Chondrodysplasia, Grebe type, 200700 |
| 601154 | Cardiomyopathy, dilated, 1E |
| 601199 | Neonatal hyperparathyroidism, 239200 |
| 601199 | Hypocalcemia, autosomal dominant, 601198 |
| 601199 | Hypocalciuric hypercalcemia, type I, 145980 |
| 601202 | Cataract, anterior polar-2 |
| 601208 | Insulin-dependent diabetes mellitus-11 |
| 601226 | Progressive external ophthalmoplegia, type 2 |
| 601238 | Cerebellar ataxia, Cayman type |
| 601277 | Ichthyosis, lamellar, type 2 |
| 601282 | Muscular dystrophy with epidermolysis bullosa simplex, 226670 |
| 601284 | Hereditary hemorrhagic telangiectasia-2, 600376 |
| 601295 | Bile acid malabsorption, primary |
| 601309 | Basal cell carcinoma, sporadic |
| 601309 | Basal cell nevus syndrome, 109400 |
| 601313 | Polycystic kidney disease, adult type I, 173900 |
| 601316 | Deafness, autosomal dominant 10 |
| 601318 | Diabetes mellitus, insulin-dependent, 13 |
| 601362 | DiGeorge syndrome/velocardiofacial syndrome complex-2 |
| 601363 | Wilms tumor, type 4 |
| 601369 | Deafness, autosomal dominant 9 |
| 601382 | Charcot-Marie-Tooth neuropathy-4B |
| 601385 | Prostate cancer |
| 601386 | Deafness, autosomal recessive 12 |
| 601387 | Breast cancer |
| 601399 | Platelet disorder, familial, with associated myeloid malignancy |
| 601402 | Leukemia, myeloid, acute |
| 601406 | B-cell non-Hodgkin lymphoma, high-grade |
| 601410 | Diabetes mellitus, transient neonatal |
| 601412 | Deafness, autosomal dominant 7 |

TABLE 5-continued

| OMIM Reference | Description |
| --- | --- |
| 601414 | Retinitis pigmentosa-18 |
| 601455 | Hereditary motor and sensory neuropathy, Lom type |
| 601458 | Inflammatory bowel disease-2 |
| 601471 | Moebius syndrome-2 |
| 601472 | Charcot-Marie-Tooth neuropathy-2D |
| 601493 | Cardiomyopathy, dilated 1C |
| 601494 | Cardiomyopathy, familial, dilated-2 |
| 601498 | Peroxisomal biogenesis disorder, complementation group 4 |
| 601517 | Spinocerebellar ataxia-2, 183090 |
| 601518 | Prostate cancer, hereditary, 1, 176807 |
| 601542 | Rieger syndrome, type 1, 180500 |
| 601545 | Lissencephaly-1 |
| 601556 | Spinocerebellar ataxia-1, 164400 |
| 601567 | Combined factor V and VIII deficiency, 227300 |
| 601596 | Charcot-Marie-Tooth neuropathy, demyelinating |
| 601604 | Mycobacterial and salmonella infections, susceptibility to |
| 601606 | Trichoepithelioma, multiple familial |
| 601607 | Rhabdoid tumors |
| 601620 | Holt-Oram syndrome, 142900 |
| 601621 | Ulnar-mammary syndrome, 181450 |
| 601622 | Saethre-Chotzen syndrome, 101400 |
| 601623 | Angelman syndrome |
| 601649 | Blepharophimosis, epicanthus inversus, and ptosis, type 2 |
| 601650 | Paraganglioma, familial nonchromaffin, 2 |
| 601652 | Glaucoma 1A, primary open angle, juvenile-onset, 137750 |
| 601666 | Insulin-dependent diabetes mellitus-15 |
| 601669 | Hirschsprung disease, one form |
| 601676 | Acute insulin response |
| 601680 | Distal arthrogryposis, type 2B |
| 601682 | Glaucoma 1C, primary open angle |
| 601687 | Meesmann corneal dystrophy, 122100 |
| 601690 | Platelet-activating factor acetylhydrolase deficiency |
| 601691 | Retinitis pigmentosa-19, 601718 |
| 601691 | Stargardt disease-1, 248200 |
| 601691 | Cone-rod dystrophy 3 |
| 601691 | Fundus flavimaculatus with macular dystrophy, 248200 |
| 601692 | Reis-Bucklers corneal dystrophy |
| 601692 | Corneal dystrophy, Avellino type |
| 601692 | Corneal dystrophy, Groenouw type I, 121900 |
| 601692 | Corneal dystrophy, lattice type I, 122200 |
| 601718 | Retinitis pigmentosa-19 |
| 601744 | Systemic lupus erythematosus, susceptibility to, 1 |
| 601757 | Rhizomelic chondrodysplasia punctata, type 1, 215100 |
| 601769 | Osteoporosis, involutional |
| 601769 | Rickets, vitamin D-resistant, 277440 |
| 601771 | Glaucoma 3A, primary infantile, 231300 |
| 601777 | Cone dystrophy, progressive |
| 601780 | Ceroid-lipofuscinosis, neuronal-6, variant late infantile |
| 601785 | Carbohydrate-deficient glycoprotein syndrome, type I, 212065 |
| 601800 | [Hair color, brown] |
| 601843 | Hypothyroidism, congenital, 274400 |
| 601844 | Pseudohypoaldosteronism type II |
| 601846 | Muscular dystrophy with rimmed vacuoles |
| 601850 | Retinitis pigmentosa-deafness syndrome |
| 601863 | Bare lymphocyte syndrome, complementation group C |
| 601868 | Deafness, autosomal dominant 13 |
| 601884 | [High bone mass] |
| 601885 | Cataract, zonular pulverulent-2 |
| 601889 | Lymphoma, diffuse large cell |
| 601916 | Pancreatic cancer |
| 601920 | Alagille syndrome, 118450 |
| 601928 | Monilethrix, 158000 |
| 601954 | Muscular dystrophy, limb-girdle, type 2G |
| 601969 | Medulloblastoma, 155255 |
| 601969 | Glioblastoma multiforme, 137800 |
| 601975 | Ectodermal dysplasia/skin fragility syndrome |
| 601990 | Neuroblastoma |
| 602014 | Hypomagnesemia with secondary hypocalcemia |
| 602023 | Bartter syndrome, type 3 |
| 602025 | Obesity/hyperinsulinism, susceptibility to |
| 602028 | Multiple myeloma |
| 602066 | Convulsions, infantile and paroxysmal choreoathetosis |
| 602078 | Fibrosis of extraocular muscles, congenital, 2 |
| 602080 | Paget disease of bone-2 |
| 602082 | Corneal dystrophy, Thiel-Behnke type |
| 602084 | Endometrial carcinoma |
| 602085 | Postaxial polydactyly, type A2 |
| 602086 | Arrhythmogenic right ventricular dysplasia-3 |
| 602087 | Arrhythmogenic right ventricular dysplasia-4 |
| 602088 | Nephronophthisis, infantile |
| 602089 | Hemangioma, capillary, hereditary |
| 602092 | Deafness, autosomal recessive 18 |
| 602094 | Lipodystrophy, familial partial |
| 602096 | Alzheimer disease-5 |
| 602099 | Amytrophic lateral sclerosis-5 |
| 602116 | Glioma |
| 602117 | Prader-Willi syndrome |
| 602121 | Deafness, autosomal dominant nonsyndromic sensorineural, 1, 124900 |
| 602134 | Tremor, familial essential, 2 |
| 602136 | Refsum disease, infantile, 266510 |
| 602136 | Zellweger syndrome-1, 214100 |
| 602136 | Adrenoleukodystrophy, neonatal, 202370 |
| 602153 | Monilethrix, 158000 |
| 602216 | Peutz-Jeghers syndrome, 175200 |
| 602221 | Stem-cell leukemia/lymphoma syndrome |
| 602225 | Cone-rod retinal dystrophy-2, 120970 |
| 602225 | Leber congenital amaurosis, type III |
| 602229 | Waardenburg-Shah syndrome, 277580 |
| 602232 | Epilepsy, benign neonatal, type 2, 121201 |
| 602235 | Epilepsy, benign, neonatal, type 1, 121200 |
| 602279 | Oculopharyngeal muscular dystrophy, 164300 |
| 602279 | Oculopharyngeal muscular dystrophy, autosomal recessive, 257950 |
| 602280 | Retinitis pigmentosa-14, 600132 |
| 602363 | Ellis-van Creveld-like syndrome |
| 602403 | Alzheimer disease, susceptibility to |
| 602404 | Parkinson disease, type 3 |
| 602421 | Sweat chloride elevation without CF |
| 602421 | Congenital bilateral absence of vas deferens, 277180 |
| 602421 | Cystic fibrosis, 219700 |
| 602447 | Coronary artery disease, susceptibility to |
| 602460 | Deafness, autosomal dominant 15, 602459 |
| 602475 | Ossification of posterior longitudinal ligament of spine |
| 602477 | Febrile convulsions, familial, 2 |
| 602491 | Hyperlipidemia, familial combined, 1 |
| 602522 | Bartter syndrome, infantile, with sensorineural deafness |
| 602544 | Parkinson disease, juvenile, type 2, 600116 |
| 602568 | Homocystinuria-megaloblastic anemia, cbl E type, 236270 |
| 602574 | Deafness, autosomal dominant 12, 601842 |
| 602574 | Deafness, autosomal dominant 8, 601543 |
| 602575 | Nail-patella syndrome with open-angle glaucoma, 137750 |
| 602575 | Nail-patella syndrome, 161200 |
| 602629 | Dystonia-6, torsion |
| 602631 | Rhabdomyosarcoma, 268210 |
| 602631 | Breast Cancer |
| 602666 | Deafness, autosomal recessive 3, 600316 |
| 602685 | Mental retardation, severe, with spasticity and tapetoretinal degeneration |
| 602716 | Nephrosis-1, congenital, Finnish type, 256300 |
| 602759 | Prostate cancer, hereditary, 2, 176807 |
| 602771 | Muscular dystrophy, congenital, with early spine rigidity |
| 602772 | Retinitis pitmentosa-24 |
| 602782 | Faisalabad histiocytosis |
| 602783 | Spastic paraplegia-7 |

Mature Polypeptides

The present invention also encompasses mature forms of a polypeptide having the amino acid sequence of SEQ ID NO:Y and/or the amino acid sequence encoded by the cDNA in a deposited clone. Polynucleotides encoding the mature forms (such as, for example, the polynucleotide sequence in SEQ ID NO:X and/or the polynucleotide sequence contained in the cDNA of a deposited clone) are also encompassed by the invention. Moreover, fragments or variants of these polypeptides (such as, fragments as described herein, polypeptides at least 80%, 85%, 90%, 95%, 96%, 97%, 98%, 99%, or 100% identical to these polypeptides, or polypeptides encoded by a polynucleotide that hybridizes under stringent conditions to the complementary strand of the polynucleotide encoding these polypeptides) are also encompassed by the invention. In preferred embodiments, these fragments or variants retain one or more functional activities of the full-length or mature form of the polypeptide (e.g., biological activity (such as, for example, activity in detecting, preventing, treating and/or indicated disorders), antigenicity (ability to bind, or compete with a polypeptide of the invention for binding, to an anti-polypeptide of the invention antibody), immunogenicity (ability to generate antibody which binds to a specific polypeptide of the invention), ability to form multimers with polypeptides of the invention, and ability to bind to a receptor or ligand for a polypeptide of the invention). Antibodies that bind the polypeptides of the invention, and polynucleotides encoding these polypeptides are also encompassed by the invention.

According to the signal hypothesis, proteins secreted by mammalian cells have a signal or secretary leader sequence which is cleaved from the mature protein once export of the growing protein chain across the rough endoplasmic reticulum has been initiated. Most mammalian cells and even insect cells cleave secreted proteins with the same specificity. However, in some cases, cleavage of a secreted protein is not entirely uniform, which results in two or more mature species of the protein. Further, it has long been known that cleavage specificity of a secreted protein is ultimately determined by the primary structure of the complete protein, that is, it is inherent in the amino acid sequence of the polypeptide.

Methods for predicting whether a protein has a signal sequence, as well as the cleavage point for that sequence, are available. For instance, the method of McGeoch, Virus Res. 3:271-286 (1985), uses the information from a short N-terminal charged region and a subsequent uncharged region of the complete (uncleaved) protein. The method of von Heinje, Nucleic Acids Res. 14:4683-4690 (1986) uses the information from the residues surrounding the cleavage site, typically residues −13 to +2, where +1 indicates the amino terminus of the secreted protein. The accuracy of predicting the cleavage points of known mammalian secretory proteins for each of these methods is in the range of 75-80%. (von Heinje, supra.) However, the two methods do not always produce the same predicted cleavage point(s) for a given protein.

In the present case, the deduced amino acid sequence of the secreted polypeptide was analyzed by a computer program called SignalP (Henrik Nielsen et al., Protein Engineering 10:1-6 (1997)), which predicts the cellular location of a protein based on the amino acid sequence. As part of this computational prediction of localization, the methods of McGeoch and von Heinje are incorporated. The analysis of the amino acid sequences of the secreted proteins described herein by this program provided the results shown in Table 1A.

In specific embodiments, polypeptides of the invention comprise, or alternatively consist of, the predicted mature form of the polypeptide as delineated in columns 14 and 15 of Table 1A. Moreover, fragments or variants of these polypeptides (such as, fragments as described herein, polypeptides at least 80%, 85%, 90%, 95%, 96%, 97%, 98%, 99%, or 100% identical to these polypeptides, or polypeptides encoded by a polynucleotide that hybridizes under stringent conditions to the complementary strand of the polynucleotide encoding these polypeptides) are also encompassed by the invention. In preferred embodiments, these fragments or variants retain one or more functional activities of the full-length or mature form of the polypeptide (e.g., biological activity, antigenicity [ability to bind (or compete with a polypeptide of the invention for binding) to an anti-polypeptide of the invention antibody], immunogenicity (ability to generate antibody which binds to a specific polypeptide of the invention), ability to form multimers with polypeptides of the invention, and ability to bind to a receptor or ligand for a polypeptide of the invention). Antibodies that bind the polypeptides of the invention, and polynucleotides encoding these polypeptides are also encompassed by the invention.

Polynucleotides encoding proteins comprising, or consisting of, the predicted mature form of polypeptides of the invention (e.g., polynucleotides having the sequence of SEQ ID NO: X (Table 1A, column 4), the sequence delineated in columns 7 and 8 of Table 1A, and a sequence encoding the mature polypeptide delineated in columns 14 and 15 of Table 1A (e.g., the sequence of SEQ ID NO:X encoding the mature polypeptide delineated in columns 14 and 15 of Table 1)) are also encompassed by the invention, as are fragments or variants of these polynucleotides (such as, fragments as described herein, polynucleotides at least 80%, 85%, 90%, 95%, 96%, 97%, 98%, 99%, or 100% identical to these polynucleotides, and nucleic acids which hybridizes under stringent conditions to the complementary strand of the polynucleotide).

As one of ordinary skill would appreciate, however, cleavage sites sometimes vary from organism to organism and cannot be predicted with absolute certainty. Accordingly, the present invention provides secreted polypeptides having a sequence shown in SEQ ID NO:Y which have an N-terminus beginning within 15 residues of the predicted cleavage point (i.e., having 1, 2, 3, 4, 5, 6, 7, 8, 9, 10, 11, 12, 13, 14, or 15 more or less contiguous residues of SEQ ID NO:Y at the N-terminus when compared to the predicted mature form of the polypeptide (e.g., the mature polypeptide delineated in columns 14 and 15 of Table 1). Similarly, it is also recognized that in some cases, cleavage of the signal sequence from a secreted protein is not entirely uniform, resulting in more than one secreted species. These polypeptides, and the polynucleotides encoding such polypeptides, are contemplated by the present invention.

Moreover, the signal sequence identified by the above analysis may not necessarily predict the naturally occurring signal sequence. For example, the naturally occurring signal sequence may be further upstream from the predicted signal sequence. However, it is likely that the predicted signal sequence will be capable of directing the secreted protein to the ER. Nonetheless, the present invention provides the mature protein produced by expression of the polynucleotide sequence of SEQ ID NO:X and/or the polynucleotide sequence contained in the cDNA of a deposited clone, in a mammalian cell (e.g., COS cells, as described below). These polypeptides, and the polynucleotides encoding such polypeptides, are contemplated by the present invention.

Polynucleotide and Polypeptide Variants

The present invention is also directed to variants of the polynucleotide sequence disclosed in SEQ ID NO:X or the complementary strand thereto, nucleotide sequences encoding the polypeptide of SEQ ID NO:Y, the nucleotide sequence of SEQ ID NO:X that encodes the polypeptide sequence as defined in columns 13 and 14 of Table 1A, nucleotide sequences encoding the polypeptide sequence as defined in columns 13 and 14 of Table 1A, the nucleotide sequence of SEQ ID NO:X encoding the polypeptide sequence as defined in column 5 of Table 1B.1, nucleotide sequences encoding the polypeptide as defined in column 6 and column 7 of Table 1B.1, the nucleotide sequence as defined in columns 8 and 9 of Table 2, nucleotide sequences encoding the polypeptide encoded by the nucleotide sequence as defined in columns 8 and 9 of Table 2, the nucleotide sequence as defined in column 6 of Table 1C, nucleotide sequences encoding the polypeptide encoded by the nucleotide sequence as defined in column 6 of Table 1C, the cDNA sequence contained in ATCC™ Deposit NO:Z, nucleotide sequences encoding the polypeptide encoded by the cDNA sequence contained in ATCC™ Deposit NO:Z, and/or nucleotide sequences encoding a mature (secreted) polypeptide encoded by the cDNA sequence contained in ATCC™ Deposit NO:Z.

The present invention also encompasses variants of the polypeptide sequence disclosed in SEQ ID NO:Y, the polypeptide as defined in columns 13 and 14 of Table 1A, the polypeptide sequence as defined in columns 6 and 7 of Table 1B.1, a polypeptide sequence encoded by the polynucleotide sequence in SEQ ID NO:X, a polypeptide sequence encoded by the nucleotide sequence as defined in columns 8 and 9 of Table 2, a polypeptide sequence encoded by the nucleotide sequence as defined in column 6 of Table 1C, a polypeptide sequence encoded by the complement of the polynucleotide sequence in SEQ ID NO:X, the polypeptide sequence encoded by the cDNA sequence contained in ATCC™ Deposit NO. Z and/or a mature (secreted) polypeptide encoded by the cDNA sequence contained in ATCC™ Deposit NO:Z.

"Variant" refers to a polynucleotide or polypeptide differing from the polynucleotide or polypeptide of the present invention, but retaining essential properties thereof. Generally, variants are overall closely similar, and, in many regions, identical to the polynucleotide or polypeptide of the present invention.

Thus, one aspect of the invention provides an isolated nucleic acid molecule comprising, or alternatively consisting of, a polynucleotide having a nucleotide sequence selected from the group consisting of: (a) a nucleotide sequence described in SEQ ID NO:X or contained in the cDNA sequence of ATCC™ Deposit No:Z; (b) a nucleotide sequence in SEQ ID NO:X or the cDNA in ATCC™ Deposit No:Z which encodes the complete amino acid sequence of SEQ ID NO:Y or the complete amino acid sequence encoded by the cDNA in ATCC™ Deposit No:Z; (c) a nucleotide sequence in SEQ ID NO:X or the cDNA in ATCC™ Deposit No:Z which encodes a mature polypeptide (i.e., a secreted polypeptide (e.g., as delineated in columns 14 and 15 of Table 1A)); (d) a nucleotide sequence in SEQ ID NO:X or the cDNA sequence of ATCC™ Deposit No:Z, which encodes a biologically active fragment of a polypeptide; (e) a nucleotide sequence in SEQ ID NO:X or the cDNA sequence of ATCC™ Deposit No:Z, which encodes an antigenic fragment of a polypeptide; (f) a nucleotide sequence encoding a polypeptide comprising the complete amino acid sequence of SEQ ID NO:Y or the complete amino acid sequence encoded by the cDNA in ATCC™ Deposit No:Z; (g) a nucleotide sequence encoding a mature polypeptide of the amino acid sequence of SEQ ID NO:Y (i.e., a secreted polypeptide (e.g., as delineated in columns 14 and 15 of Table 1A)) or a mature polypeptide of the amino acid sequence encoded by the cDNA in ATCC™ Deposit No:Z; (h) a nucleotide sequence encoding a biologically active fragment of a polypeptide having the complete amino acid sequence of SEQ ID NO:Y or the complete amino acid sequence encoded by the cDNA in ATCC™ Deposit No:Z; (i) a nucleotide sequence encoding an antigenic fragment of a polypeptide having the complete amino acid sequence of SEQ ID NO:Y or the complete amino acid sequence encoded by the cDNA in ATCC™ Deposit No:Z; and (j) a nucleotide sequence complementary to any of the nucleotide sequences in (a), (b), (c), (d), (e), (f), (g), (h), or (i) above.

The present invention is also directed to nucleic acid molecules which comprise, or alternatively consist of, a nucleotide sequence which is at least 80%, 85%, 90%, 95%, 96%, 97%, 98%, 99% or 100%, identical to, for example, any of the nucleotide sequences in (a), (b), (c), (d), (e), (f), (g), (h), (i), or (j) above, the nucleotide coding sequence in SEQ ID NO:X or the complementary strand thereto, the nucleotide coding sequence of the cDNA contained in ATCC™ Deposit No:Z or the complementary strand thereto, a nucleotide sequence encoding the polypeptide of SEQ ID NO:Y, a nucleotide sequence encoding a polypeptide sequence encoded by the nucleotide sequence in SEQ ID NO:X, a polypeptide sequence encoded by the complement of the polynucleotide sequence in SEQ ID NO:X, a nucleotide sequence encoding the polypeptide encoded by the cDNA contained in ATCC™ Deposit No:Z, the nucleotide coding sequence in SEQ ID NO:X as defined in columns 8 and 9 of Table 2 or the complementary strand thereto, a nucleotide sequence encoding the polypeptide encoded by the nucleotide sequence in SEQ ID NO:X as defined in columns 8 and 9 of Table 2 or the complementary strand thereto, the nucleotide coding sequence in SEQ ID NO:B as defined in column 6 of Table 1C or the complementary strand thereto, a nucleotide sequence encoding the polypeptide encoded by the nucleotide sequence in SEQ ID NO:B as defined in column 6 of Table 1C or the complementary strand thereto, the nucleotide sequence in SEQ ID NO:X encoding the polypeptide sequence as defined in columns 6 and 7 of Table 1B.1 or the complementary strand thereto, nucleotide sequences encoding the polypeptide as defined in column 6 and 7 of Table 1B.1 or the complementary strand thereto, and/or polynucleotide fragments of any of these nucleic acid molecules (e.g., those fragments described herein). Polynucleotides which hybridize to the complement of these nucleic acid molecules under stringent hybridization conditions or alternatively, under lower stringency conditions, are also encompassed by the invention, as are polypeptides encoded by these polynucleotides and nucleic acids.

In a preferred embodiment, the invention encompasses nucleic acid molecules which comprise, or alternatively, consist of a polynucleotide which hybridizes under stringent hybridization conditions, or alternatively, under lower stringency conditions, to a polynucleotide in (a), (b), (c), (d), (e), (f), (g), (h), or (i), above, as are polypeptides encoded by these polynucleotides. In another preferred embodiment, polynucleotides which hybridize to the complement of these nucleic acid molecules under stringent hybridization conditions, or alternatively, under lower stringency conditions, are also encompassed by the invention, as are polypeptides encoded by these polynucleotides.

In another embodiment, the invention provides a purified protein comprising, or alternatively consisting of, a polypeptide having an amino acid sequence selected from the group consisting of: (a) the complete amino acid sequence of SEQ ID NO:Y or the complete amino acid sequence encoded by the cDNA in ATCC™ Deposit No:Z; (b) the amino acid sequence of a mature (secreted) form of a polypeptide having the amino acid sequence of SEQ ID NO:Y (e.g., as delineated in columns 14 and 15 of Table 1A) or a mature form of the amino acid sequence encoded by the cDNA in ATCC™ Deposit No:Z mature; (c) the amino acid sequence of a biologically active fragment of a polypeptide having the complete amino acid sequence of SEQ ID NO:Y or the complete amino acid sequence encoded by the cDNA in ATCC™ Deposit No:Z; and (d) the amino acid sequence of an antigenic fragment of a polypeptide having the complete amino acid sequence of SEQ ID NO:Y or the complete amino acid sequence encoded by the cDNA in ATCC™ Deposit No:Z.

The present invention is also directed to proteins which comprise, or alternatively consist of, an amino acid sequence which is at least 80%, 85%, 90%, 95%, 96%, 97%, 98%, 99% or 100%, identical to, for example, any of the amino acid sequences in (a), (b), (c), or (d), above, the amino acid sequence shown in SEQ ID NO:Y, the amino acid sequence encoded by the cDNA contained in ATCC™ Deposit No:Z, the amino acid sequence of the polypeptide encoded by the nucleotide sequence in SEQ ID NO:X as defined in columns 8 and 9 of Table 2, the amino acid sequence of the polypeptide encoded by the nucleotide sequence in SEQ ID NO:B as defined in column 6 of Table 1C, the amino acid sequence as defined in column 6 and 7 of Table 1B.1, an amino acid sequence encoded by the nucleotide sequence in SEQ ID NO:X, and an amino acid sequence encoded by the complement of the polynucleotide sequence in SEQ ID NO:X. Fragments of these polypeptides are also provided (e.g., those fragments described herein). Further proteins encoded by polynucleotides which hybridize to the complement of the nucleic acid molecules encoding these amino acid sequences under stringent hybridization conditions or alternatively, under lower stringency conditions, are also encompassed by the invention, as are the polynucleotides encoding these proteins.

By a nucleic acid having a nucleotide sequence at least, for example, 95% "identical" to a reference nucleotide sequence of the present invention, it is intended that the nucleotide sequence of the nucleic acid is identical to the reference sequence except that the nucleotide sequence may include up to five point mutations per each 100 nucleotides of the reference nucleotide sequence encoding the polypeptide. In other words, to obtain a nucleic acid having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. The query sequence may be an entire sequence referred to in Table 1B or 2 as the ORF (open reading frame), or any fragment specified as described herein.

As a practical matter, whether any particular nucleic acid molecule or polypeptide is at least 80%, 85%, 90%, 95%, 96%, 97%, 98% or 99% identical to a nucleotide sequence of the present invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. 6:237-245 (1990)). In a sequence alignment the query and subject sequences are both DNA sequences. An RNA sequence can be compared by converting U's to T's. The result of said global sequence alignment is expressed as percent identity. Preferred parameters used in a FASTDB alignment of DNA sequences to calculate percent identity are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the length of the subject nucleotide sequence, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignment of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequence are manually corrected for. No other manual corrections are to be made for the purposes of the present invention.

By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, (indels) or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98% or 99% identical to, for instance, the amino acid sequence of a polypeptide referred to in Table 1A (e.g., the amino acid sequence delineated in columns 14 and 15) or a fragment thereof, Table 1B.1 (e.g., the amino acid sequence identified in column 6) or a fragment thereof, Table 2 (e.g., the amino acid sequence of the polypeptide encoded by the polynucleotide sequence defined in columns 8 and 9 of Table 2) or a fragment thereof, the amino acid sequence of the polypeptide encoded by the polynucleotide sequence in SEQ ID NO:B as defined in column 6 of Table 1C or a fragment thereof, the amino acid sequence of the polypeptide encoded by the nucleotide sequence in SEQ ID NO:X or a fragment thereof, or the amino acid sequence of the polypeptide encoded by cDNA contained in ATCC™ Deposit No:Z, or a fragment thereof, the amino acid sequence of a mature (secreted) polypeptide encoded by cDNA contained in ATCC™ Deposit No:Z, or a fragment thereof, can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. 6:237-245 (1990)). In a sequence alignment the query and subject sequences are either both nucleotide sequences or both amino acid sequences. The result of said global sequence alignment is expressed as percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/ aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to made for the purposes of the present invention.

The polynucleotide variants of the invention may contain alterations in the coding regions, non-coding regions, or both. Especially preferred are polynucleotide variants containing alterations which produce silent substitutions, additions, or deletions, but do not alter the properties or activities of the encoded polypeptide. Nucleotide variants produced by silent substitutions due to the degeneracy of the genetic code are preferred. Moreover, polypeptide variants in which less than 50, less than 40, less than 30, less than 20, less than 10, or 5-50, 5-25, 5-10, 1-5, or 1-2 amino acids are substituted, deleted, or added in any combination are also preferred. Polynucleotide variants can be produced for a variety of reasons, e.g., to optimize codon expression for a particular host (change codons in the human mRNA to those preferred by a bacterial host such as *E. coli*).

Naturally occurring variants are called "allelic variants," and refer to one of several alternate forms of a gene occupying a given locus on a chromosome of an organism. (Genes II, Lewin, B., ed., John Wiley & Sons, New York (1985)). These allelic variants can vary at either the polynucleotide and/or polypeptide level and are included in the present invention. Alternatively, non-naturally occurring variants may be produced by mutagenesis techniques or by direct synthesis.

Using known methods of protein engineering and recombinant DNA technology, variants may be generated to improve or alter the characteristics of the polypeptides of the present invention. For instance, one or more amino acids can be deleted from the N-terminus or C-terminus of the polypeptide of the present invention without substantial loss of biological function. As an example, Ron et al. (J. Biol. Chem. 268: 2984-2988 (1993)) reported variant KGF proteins having heparin binding activity even after deleting 3, 8, or 27 amino-terminal amino acid residues. Similarly, Interferon gamma exhibited up to ten times higher activity after deleting 8-10 amino acid residues from the carboxy terminus of this protein. (Dobeli et al., J. Biotechnology 7:199-216 (1988).)

Moreover, ample evidence demonstrates that variants often retain a biological activity similar to that of the naturally occurring protein. For example, Gayle and coworkers (J. Biol. Chem. 268:22105-22111 (1993)) conducted extensive mutational analysis of human cytokine IL-1a. They used random mutagenesis to generate over 3,500 individual IL-1a mutants that averaged 2.5 amino acid changes per variant over the entire length of the molecule. Multiple mutations were examined at every possible amino acid position. The investigators found that "[m]ost of the molecule could be altered with little effect on either [binding or biological activity]." In fact, only 23 unique amino acid sequences, out of more than 3,500 nucleotide sequences examined, produced a protein that significantly differed in activity from wild-type.

Furthermore, even if deleting one or more amino acids from the N-terminus or C-terminus of a polypeptide results in modification or loss of one or more biological functions, other biological activities may still be retained. For example, the ability of a deletion variant to induce and/or to bind antibodies which recognize the secreted form will likely be retained when less than the majority of the residues of the secreted form are removed from the N-terminus or C-terminus. Whether a particular polypeptide lacking N- or C-terminal residues of a protein retains such immunogenic activities can readily be determined by routine methods described herein and otherwise known in the art.

Thus, the invention further includes polypeptide variants which show a functional activity (e.g., biological activity) of the polypeptides of the invention. Such variants include deletions, insertions, inversions, repeats, and substitutions selected according to general rules known in the art so as have little effect on activity.

The present application is directed to nucleic acid molecules at least 80%, 85%, 90%, 95%, 96%, 97%, 98%, 99% or 100% identical to the nucleic acid sequences disclosed herein, (e.g., encoding a polypeptide having the amino acid sequence of an N and/or C terminal deletion), irrespective of whether they encode a polypeptide having functional activity. This is because even where a particular nucleic acid molecule does not encode a polypeptide having functional activity, one of skill in the art would still know how to use the nucleic acid molecule, for instance, as a hybridization probe or a polymerase chain reaction (PCR) primer. Uses of the nucleic acid molecules of the present invention that do not encode a polypeptide having functional activity include, inter alia, (1) isolating a gene or allelic or splice variants thereof in a cDNA library; (2) in situ hybridization (e.g., "FISH") to metaphase chromosomal spreads to provide precise chromosomal location of the gene, as described in Verma et al., Human Chromosomes: A Manual of Basic Techniques, Pergamon Press, New York (1988); (3) Northern Blot analysis for detecting mRNA expression in specific tissues (e.g., normal or diseased tissues); and (4) in situ hybridization (e.g., histochemistry) for detecting mRNA expression in specific tissues (e.g., normal or diseased tissues).

Preferred, however, are nucleic acid molecules having sequences at least 80%, 85%, 90%, 95%, 96%, 97%, 98%, 99% or 100% identical to the nucleic acid sequences disclosed herein, which do, in fact, encode a polypeptide having functional activity. By a polypeptide having "functional activity" is meant, a polypeptide capable of displaying one or more known functional activities associated with a full-length (complete) protein and/or a mature (secreted) protein of the invention. Such functional activities include, but are not limited to, biological activity, antigenicity [ability to bind (or compete with a polypeptide of the invention for binding) to an anti-polypeptide of the invention antibody], immunogenicity (ability to generate antibody which binds to a specific polypeptide of the invention), ability to form multimers with polypeptides of the invention, and ability to bind to a receptor or ligand for a polypeptide of the invention.

The functional activity of the polypeptides, and fragments, variants and derivatives of the invention, can be assayed by various methods.

For example, in one embodiment where one is assaying for the ability to bind or compete with a full-length polypeptide of the present invention for binding to an anti-polypeptide antibody, various immunoassays known in the art can be used, including but not limited to, competitive and non-competitive assay systems using techniques such as radioimmunoassays, ELISA (enzyme linked immunosorbent assay), "sandwich" immunoassays, immunoradiometric assays, gel diffusion precipitation reactions, immunodiffusion assays, in situ immunoassays (using colloidal gold, enzyme or radioisotope labels, for example), western blots, precipitation reactions, agglutination assays (e.g., gel agglutination assays, hemagglutination assays), complement fixation assays, immunofluorescence assays, protein A assays, and immunoelectrophoresis assays, etc. In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention.

In another embodiment, where a ligand is identified, or the ability of a polypeptide fragment, variant or derivative of the invention to multimerize is being evaluated, binding can be assayed, e.g., by means well-known in the art, such as, for example, reducing and non-reducing gel chromatography, protein affinity chromatography, and affinity blotting. See generally, Phizicky et al., Microbiol. Rev. 59:94-123 (1995). In another embodiment, the ability of physiological correlates of a polypeptide of the present invention to bind to a substrate(s) of the polypeptide of the invention can be routinely assayed using techniques known in the art.

In addition, assays described herein (see Examples) and otherwise known in the art may routinely be applied to measure the ability of polypeptides of the present invention and fragments, variants and derivatives thereof to elicit polypeptide related biological activity (either in vitro or in vivo). Other methods will be known to the skilled artisan and are within the scope of the invention.

Of course, due to the degeneracy of the genetic code, one of ordinary skill in the art will immediately recognize that a large number of the nucleic acid molecules having a sequence at least 80%, 85%, 90%, 95%, 96%, 97%, 98%, 99%, or 100% identical to, for example, the nucleic acid sequence of the cDNA contained in ATCC™ Deposit No:Z, the nucleic acid sequence referred to in Table 1B (SEQ ID NO:X), the nucleic acid sequence disclosed in Table 1A (e.g., the nucleic acid sequence delineated in columns 7 and 8), the nucleic acid sequence disclosed in Table 2 (e.g., the nucleic acid sequence delineated in columns 8 and 9) or fragments thereof, will encode polypeptides "having functional activity." In fact, since degenerate variants of any of these nucleotide sequences all encode the same polypeptide, in many instances, this will be clear to the skilled artisan even without performing the above described comparison assay. It will be further recognized in the art that, for such nucleic acid molecules that are not degenerate variants, a reasonable number will also encode a polypeptide having functional activity. This is because the skilled artisan is fully aware of amino acid substitutions that are either less likely or not likely to significantly effect protein function (e.g., replacing one aliphatic amino acid with a second aliphatic amino acid), as further described below.

For example, guidance concerning how to make phenotypically silent amino acid substitutions is provided in Bowie et al., "Deciphering the Message in Protein Sequences: Tolerance to Amino Acid Substitutions," Science 247:1306-1310 (1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. See Cunningham and Wells, Science 244:1081-1085 (1989). The resulting mutant molecules can then be tested for biological activity.

As the authors state, these two strategies have revealed that proteins are surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly.

Besides conservative amino acid substitution, variants of the present invention include (i) substitutions with one or more of the non-conserved amino acid residues, where the substituted amino acid residues may or may not be one encoded by the genetic code, or (ii) substitutions with one or more of the amino acid residues having a substituent group, or (iii) fusion of the mature polypeptide with another compound, such as a compound to increase the stability and/or solubility of the polypeptide (for example, polyethylene glycol), (iv) fusion of the polypeptide with additional amino acids, such as, for example, an IgG Fc fusion region peptide, serum albumin (preferably human serum albumin) or a fragment thereof, or leader or secretory sequence, or a sequence facilitating purification, or (v) fusion of the polypeptide with another compound, such as albumin (including but not limited to recombinant albumin (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)). Such variant polypeptides are deemed to be within the scope of those skilled in the art from the teachings herein.

For example, polypeptide variants containing amino acid substitutions of charged amino acids with other charged or neutral amino acids may produce proteins with improved characteristics, such as less aggregation. Aggregation of pharmaceutical formulations both reduces activity and increases clearance due to the aggregate's immunogenic activity. See Pinckard et al., Clin. Exp. Immunol. 2:331-340 (1967); Robbins et al., Diabetes 36: 838-845 (1987); Cleland et al., Crit. Rev. Therapeutic Drug Carrier Systems 10:307-377 (1993).

A further embodiment of the invention relates to polypeptides which comprise the amino acid sequence of a polypeptide having an amino acid sequence which contains at least one amino acid substitution, but not more than 50 amino acid substitutions, even more preferably, not more than 40 amino acid substitutions, still more preferably, not more than 30 amino acid substitutions, and still even more preferably, not more than 20 amino acid substitutions from a polypeptide sequence disclosed herein. Of course it is highly preferable for a polypeptide to have an amino acid sequence which, for example, comprises the amino acid sequence of a polypeptide of SEQ ID NO:Y, the amino acid sequence of the mature (e.g., secreted) polypeptide of SEQ ID NO:Y, an amino acid sequence encoded by SEQ ID NO:X, an amino acid sequence encoded by the portion of SEQ ID NO:X as defined in columns 8 and 9 of Table 2, an amino acid sequence encoded by the complement of SEQ ID NO:X, an amino acid sequence encoded by cDNA contained in ATCC™ Deposit No:Z, and/or the amino acid sequence of a mature (secreted) polypeptide encoded by cDNA contained in ATCC™ Deposit No:Z, or a fragment thereof, which contains, in order of ever-increasing preference, at least one, but not more than 10, 9, 8, 7, 6, 5, 4, 3, 2 or 1 amino acid substitutions.

In specific embodiments, the polypeptides of the invention comprise, or alternatively, consist of, fragments or variants of a reference amino acid sequence selected from: (a) the amino acid sequence of SEQ ID NO:Y or fragments thereof (e.g., the mature form and/or other fragments described herein); (b) the amino acid sequence encoded by SEQ ID NO:X or fragments thereof; (c) the amino acid sequence encoded by the complement of SEQ ID NO:X or fragments thereof; (d) the amino acid sequence encoded by the portion of SEQ ID NO:X as defined in columns 8 and 9 of Table 2 or fragments thereof; and (e) the amino acid sequence encoded by cDNA contained in ATCC™ Deposit No:Z or fragments thereof; wherein the fragments or variants have 1-5, 5-10, 5-25, 5-50, 10-50 or 50-150, amino acid residue additions, substitutions, and/or deletions when compared to the reference amino acid sequence. In preferred embodiments, the amino acid substitutions are conservative. Polynucleotides encoding these polypeptides are also encompassed by the invention.

Polynucleotide and Polypeptide Fragments

The present invention is also directed to polynucleotide fragments of the polynucleotides (nucleic acids) of the invention. In the present invention, a "polynucleotide fragment" refers to a polynucleotide having a nucleic acid sequence which, for example: is a portion of the cDNA contained in ATCC™ Deposit No:Z or the complementary strand thereto; is a portion of the polynucleotide sequence encoding the polypeptide encoded by the cDNA contained in ATCC™ Deposit No:Z or the complementary strand thereto; is a portion of the polynucleotide sequence encoding the mature (secreted) polypeptide encoded by the cDNA contained in ATCC™ Deposit No:Z or the complementary strand thereto; is a portion of a polynucleotide sequence encoding the mature amino acid sequence as defined in columns 14 and 15 of Table 1A or the complementary strand thereto; is a portion of a polynucleotide sequence encoding the amino acid sequence encoded by the region of SEQ ID NO:X as defined in columns 8 and 9 of Table 2 or the complementary strand thereto; is a portion of the polynucleotide sequence of SEQ ID NO:X as defined in columns 8 and 9 of Table 2 or the complementary strand thereto; is a portion of the polynucleotide sequence in SEQ ID NO:X or the complementary strand thereto; is a polynucleotide sequence encoding a portion of the polypeptide of SEQ ID NO:Y; is a polynucleotide sequence encoding a portion of a polypeptide encoded by SEQ ID NO:X; is a polynucleotide sequence encoding a portion of a polypeptide encoded by the complement of the polynucleotide sequence in SEQ ID NO:X; is a portion of a polynucleotide sequence encoding the amino acid sequence encoded by the region of SEQ ID NO:B as defined in column 6 of Table 1C or the complementary strand thereto; or is a portion of the polynucleotide sequence of SEQ ID NO:B as defined in column 6 of Table 1C or the complementary strand thereto.

The polynucleotide fragments of the invention are preferably at least about 15 nt, and more preferably at least about 20 nt, still more preferably at least about 30 nt, and even more preferably, at least about 40 nt, at least about 50 nt, at least about 75 nt, or at least about 150 nt in length. A fragment "at least 20 nt in length," for example, is intended to include 20 or more contiguous bases from the cDNA sequence contained in ATCC™ Deposit No:Z, or the nucleotide sequence shown in SEQ ID NO:X or the complementary stand thereto. In this context "about" includes the particularly recited value or a value larger or smaller by several (5, 4, 3, 2, or 1) nucleotides, at either terminus or at both termini. These nucleotide fragments have uses that include, but are not limited to, as diagnostic probes and primers as discussed herein. Of course, larger fragments (e.g., at least 160, 170, 180, 190, 200, 250, 500, 600, 1000, or 2000 nucleotides in length) are also encompassed by the invention.

Moreover, representative examples of polynucleotide fragments of the invention comprise, or alternatively consist of, a sequence from about nucleotide number 1-50, 51-100, 101-150, 151-200, 201-250, 251-300, 301-350, 351-400, 401-450, 451-500, 501-550, 551-600, 601-650, 651-700, 701-750, 751-800, 801-850, 851-900, 901-950, 951-1000, 1001-1050, 1051-1100, 1101-1150, 1151-1200, 1201-1250, 1251-1300, 1301-1350, 1351-1400, 1401-1450, 1451-1500, 1501-1550, 1551-1600, 1601-1650, 1651-1700, 1701-1750, 1751-1800, 1801-1850, 1851-1900, 1901-1950, 1951-2000, 2001-2050, 2051-2100, 2101-2150, 2151-2200, 2201-2250, 2251-2300, 2301-2350, 2351-2400, 2401-2450, 2451-2500, 2501-2550, 2551-2600, 2601-2650, 2651-2700, 2701-2750, 2751-2800, 2801-2850, 2851-2900, 2901-2950, 2951-3000, 3001-3050, 3051-3100, 3101-3150, 3151-3200, 3201-3250, 3251-3300, 3301-3350, 3351-3400, 3401-3450, 3451-3500, 3501-3550, 3551-3600, 3601-3650, 3651-3700, 3701-3750, 3751-3800, 3801-3850, 3851-3900, 3901-3950, 3951-4000, 4001-4050, 4051-4100, 4101-4150, 4151-4200, 4201-4250, 4251-4300, 4301-4350, 4351-4400, 4401-4450, 4451-4500, 4501-4550, 4551-4600, 4601-4650, 4651-4700, 4701-4750, 4751-4800, 4801-4850, 4851-4900, 4901-4950, 4951-5000, 5001-5050, 5051-5100, 5101-5150, 5151-5200, 5201-5250, 5251-5300, 5301-5350, 5351-5400, 5401-5450, 5451-5500, 5501-5550, 5551-5600, 5601-5650, 5651-5700, 5701-5750, 5751-5800, 5801-5850, 5851-5900, 5901-5950, 5951-6000, 6001-6050, 6051-6100, 6101-6150, 6151-6200, 6201-6250, 6251-6300, 6301-6350, 6351-6400, 6401-6450, 6451-6500, 6501-6550, 6551-6600, 6601-6650, 6651-6700, 6701-6750, 6751-6800, 6801-6850, 6851-6900, 6901-6950, 6951-7000, 7001-7050, 7051-7100, 7101-7150, 7151-7200, 7201-7250, 7251-7300 or 7301 to the end of SEQ ID NO:X, or the complementary strand thereto. In this context "about" includes the particularly recited range or a range larger or smaller by several (5, 4, 3, 2, or 1) nucleotides, at either terminus or at both termini. Preferably, these fragments encode a polypeptide which has a functional activity (e.g., biological activity). More preferably, these polynucleotides can be used as probes or primers as discussed herein. Polynucleotides which hybridize to one or more of these polynucleotides under stringent hybridization conditions or alternatively, under lower stringency conditions are also encompassed by the invention, as are polypeptides encoded by these polynucleotides.

Further representative examples of polynucleotide fragments of the invention comprise, or alternatively consist of, a sequence from about nucleotide number 1-50, 51-100, 101-150, 151-200, 201-250, 251-300, 301-350, 351-400, 401-450, 451-500, 501-550, 551-600, 601-650, 651-700, 701-750, 751-800, 801-850, 851-900, 901-950, 951-1000, 1001-1050, 1051-1100, 1101-1150, 1151-1200, 1201-1250, 1251-1300, 1301-1350, 1351-1400, 1401-1450, 1451-1500, 1501-1550, 1551-1600, 1601-1650, 1651-1700, 1701-1750, 1751-1800, 1801-1850, 1851-1900, 1901-1950, 1951-2000, 2001-2050, 2051-2100, 2101-2150, 2151-2200, 2201-2250, 2251-2300, 2301-2350, 2351-2400, 2401-2450, 2451-2500, 2501-2550, 2551-2600, 2601-2650, 2651-2700, 2701-2750, 2751-2800, 2801-2850, 2851-2900, 2901-2950, 2951-3000, 3001-3050, 3051-3100, 3101-3150, 3151-3200, 3201-3250, 3251-3300, 3301-3350, 3351-3400, 3401-3450, 3451-3500, 3501-3550, 3551-3600, 3601-3650, 3651-3700, 3701-3750, 3751-3800, 3801-3850, 3851-3900, 3901-3950, 3951-4000, 4001-4050, 4051-4100, 4101-4150, 4151-4200, 4201-4250, 4251-4300, 4301-4350, 4351-4400, 4401-4450, 4451-4500, 4501-4550, 4551-4600, 4601-4650, 4651-4700, 4701-4750, 4751-4800, 4801-4850, 4851-4900, 4901-4950, 4951-5000, 5001-5050, 5051-5100, 5101-5150, 5151-5200, 5201-5250, 5251-5300, 5301-5350, 5351-5400, 5401-5450, 5451-5500, 5501-5550, 5551-5600, 5601-5650, 5651-5700, 5701-5750, 5751-5800, 5801-5850, 5851-5900, 5901-5950, 5951-6000, 6001-6050, 6051-6100, 6101-6150, 6151-6200, 6201-6250, 6251-6300, 6301-6350, 6351-6400, 6401-6450, 6451-6500, 6501-6550, 6551-6600, 6601-6650, 6651-6700, 6701-6750, 6751-6800, 6801-6850, 6851-6900, 6901-6950, 6951-7000, 7001-7050, 7051-7100, 7101-7150, 7151-7200, 7201-7250, 7251-7300 or 7301 to the end of the cDNA sequence contained in ATCC™ Deposit No:Z, or the complementary strand thereto. In this context "about" includes the particularly recited range or a range larger or smaller by several (5, 4, 3, 2, or 1) nucleotides, at either terminus or at both termini. Preferably, these fragments encode a polypeptide which has a functional activity (e.g., biological activity). More preferably, these polynucleotides can be used as probes or primers as discussed herein. Polynucleotides which hybridize to one or more of these polynucleotides under stringent hybridization conditions or alternatively, under lower stringency conditions are also encompassed by the invention, as are polypeptides encoded by these polynucleotides.

Moreover, representative examples of polynucleotide fragments of the invention comprise, or alternatively consist of, a nucleic acid sequence comprising one, two, three, four, five, six, seven, eight, nine, ten, or more of the above described polynucleotide fragments of the invention in combination with a polynucleotide sequence delineated in Table 1C column 6. Additional, representative examples of polynucleotide fragments of the invention comprise, or alternatively consist of, a nucleic acid sequence comprising one, two, three, four, five, six, seven, eight, nine, ten, or more of the above described polynucleotide fragments of the invention in combination with a polynucleotide sequence that is the complementary strand of a sequence delineated in column 6 of Table 1C. In further embodiments, the above-described polynucleotide fragments of the invention comprise, or alternatively consist of, sequences delineated in Table 1C, column 6, and have a nucleic acid sequence which is different from that of the BAC fragment having the sequence disclosed in SEQ ID NO:B (see Table 1C, column 5). In additional embodiments, the above-described polynucleotide fragments of the invention comprise, or alternatively consist of, sequences delineated in Table 1C, column 6, and have a nucleic acid sequence which is different from that published for the BAC clone identified as BAC ID NO:A (see Table 1C, column 4). In additional embodiments, the above-described polynucleotides of the invention comprise, or alternatively consist of, sequences delineated Table 1C, column 6, and have a nucleic acid sequence which is different from that contained in the BAC clone identified as BAC ID NO:A (see Table 1C, column 4). Polypeptides encoded by these polynucleotides, other polynucleotides that encode these polypeptides, and antibodies that bind these polypeptides are also encompassed by the invention. Additionally, fragments and variants of the above-described polynucleotides and polypeptides are also encompassed by the invention.

In additional specific embodiments, polynucleotides of the invention comprise, or alternatively consist of, one, two, three, four, five, six, seven, eight, nine, ten, or more fragments of the sequences delineated in column 6 of Table 1C, and the polynucleotide sequence of SEQ ID NO:X (e.g., as defined in Table 1C, column 2) or fragments or variants thereof. Polypeptides encoded by these polynucleotides, other polynucleotides that encode these polypeptides, and antibodies that bind these polypeptides are also encompassed by the invention.

In additional specific embodiments, polynucleotides of the invention comprise, or alternatively consist of, one, two, three, four, five, six, seven, eight, nine, ten, or more fragments of the sequences delineated in column 6 of Table 1C which correspond to the same ATCC™ Deposit No:Z (see Table 1C, column 1), and the polynucleotide sequence of SEQ ID NO:X (e.g., as defined in Table 1A, 1B, or 1C) or fragments or variants thereof. Polypeptides encoded by these polynucleotides, other polynucleotides that encode these polypeptides, and antibodies that bind these polypeptides are also encompassed by the invention.

In further specific embodiments, polynucleotides of the invention comprise, or alternatively consist of, one, two, three, four, five, six, seven, eight, nine, ten, or more fragments of the sequences delineated in the same row of column 6 of Table 1C, and the polynucleotide sequence of SEQ ID NO:X (e.g., as defined in Table 1A, 1B, or 1C) or fragments or variants thereof. Polypeptides encoded by these polynucleotides, other polynucleotides that encode these polypeptides, and antibodies that bind these polypeptides are also encompassed by the invention.

In additional specific embodiments, polynucleotides of the invention comprise, or alternatively consist of a polynucleotide sequence in which the 3' 10 polynucleotides of one of the sequences delineated in column 6 of Table 1C and the 5' 10 polynucleotides of the sequence of SEQ ID NO:X are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids that encode these polypeptides, and antibodies that bind these polypeptides are also encompassed by the invention. Additionally, fragments and variants of the above-described polynucleotides, nucleic acids, and polypeptides are also encompassed by the invention.

In additional specific embodiments, polynucleotides of the invention comprise, or alternatively consist of a polynucleotide sequence in which the 3' 10 polynucleotides of one of the sequences delineated in column 6 of Table 1C and the 5' 10 polynucleotides of a fragment or variant of the sequence of SEQ ID NO:X (e.g., as described herein) are directly contiguous Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In further specific embodiments, polynucleotides of the invention comprise, or alternatively consist of a polynucleotide sequence in which the 3' 10 polynucleotides of a fragment or variant of the sequence of SEQ ID NO:X and the 5' 10 polynucleotides of the sequence of one of the sequences delineated in column 6 of Table 1C are directly contiguous. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In specific embodiments, polynucleotides of the invention comprise, or alternatively consist of a polynucleotide sequence in which the 3' 10 polynucleotides of one of the sequences delineated in column 6 of Table 1C and the 5' 10 polynucleotides of another sequence in column 6 are directly contiguous. In preferred embodiments, the 3' 10 polynucleotides of one of the sequences delineated in column 6 of Table 1C is directly contiguous with the 5' 10 polynucleotides of the next sequential exon delineated in Table 1C, column 6. Nucleic acids which hybridize to the complement of these 20 contiguous polynucleotides under stringent hybridization conditions or alternatively, under lower stringency conditions, are also encompassed by the invention. Polypeptides encoded by these polynucleotides and/or nucleic acids, other polynucleotides and/or nucleic acids encoding these polypeptides, and antibodies that bind these polypeptides are also encompassed by the invention. Additionally, fragments and variants of the above-described polynucleotides, nucleic acids, and polypeptides are also encompassed by the invention.

In the present invention, a "polypeptide fragment" refers to an amino acid sequence which is a portion of the amino acid sequence contained in SEQ ID NO:Y, is a portion of the mature form of SEQ ID NO:Y as defined in columns 14 and 15 of Table 1A, a portion of an amino acid sequence encoded by the portion of SEQ ID NO:X as defined in columns 8 and 9 of Table 2, is a portion of an amino acid sequence encoded by the polynucleotide sequence of SEQ ID NO:X, is a portion of an amino acid sequence encoded by the complement of the polynucleotide sequence in SEQ ID NO:X, is a portion of the amino acid sequence of a mature (secreted) polypeptide encoded by the cDNA contained in ATCC™ Deposit No:Z, and/or is a portion of an amino acid sequence encoded by the cDNA contained in ATCC™ Deposit No:Z. Protein (polypeptide) fragments may be "free-standing," or comprised within a larger polypeptide of which the fragment forms a part or region, most preferably as a single continuous region. Representative examples of polypeptide fragments of the invention, include, for example, fragments comprising, or alternatively consisting of, from about amino acid number 1-20, 21-40, 41-60, 61-80, 81-100, 101-120, 121-140, 141-160, 161-180, 181-200, 201-220, 221-240, 241-260, 261-280, 281-300, 301-320, 321-340, 341-360, 361-380, 381-400, 401-420, 421-440, 441-460, 461-480, 481-500, 501-520, 521-540, 541-560, 561-580, 581-600, 601-620, 621-640, 641-660, 661-680, 681-700, 701-720, 721-740, 741-760, 761-780, 781-800, 801-820, 821-840, 841-860, 861-880, 881-900, 901-920, 921-940, 941-960, 961-980, 981-1000, 1001-1020, 1021-1040, 1041-1060, 1061-1080, 1081-1100, 1101-1120, 1121-1140, 1141-1160, 1161-1180, 1181-1200, 1201-1220, 1221-1240, 1241-1260, 1261-1280, 1281-1300, 1301-1320, 1321-1340, 1341-1360, 1361-1380, 1381-1400, 1401-1420, 1421-1440, or 1441 to the end of the coding region of cDNA and SEQ ID NO: Y. In a preferred embodiment, polypeptide fragments of the invention include, for example, fragments comprising, or alternatively consisting of, from about amino acid number 1-20, 21-40, 41-60, 61-80, 81-100, 101-120, 121-140, 141-160, 161-180, 181-200, 201-220, 221-240, 241-260, 261-280, 281-300, 301-320, 321-340, 341-360, 361-380, 381-400, 401-420, 421-440, 441-

460, 461-480, 481-500, 501-520, 521-540, 541-560, 561-580, 581-600, 601-620, 621-640, 641-660, 661-680, 681-700, 701-720, 721-740, 741-760, 761-780, 781-800, 801-820, 821-840, 841-860, 861-880, 881-900, 901-920, 921-940, 941-960, 961-980, 981-1000, 1001-1020, 1021-1040, 1041-1060, 1061-1080, 1081-1100, 1101-1120, 1121-1140, 1141-1160, 1161-1180, 1181-1200, 1201-1220, 1221-1240, 1241-1260, 1261-1280, 1281-1300, 1301-1320, 1321-1340, 1341-1360, 1361-1380, 1381-1400, 1401-1420, 1421-1440, or 1441 to the end of the coding region of SEQ ID NO:Y. Moreover, polypeptide fragments of the invention may be at least about 10, 15, 20, 25, 30, 35, 40, 45, 50, 55, 60, 65, 70, 75, 80, 85, 90, 100, 110, 120, 130, 140, or 150 amino acids in length. In this context "about" includes the particularly recited ranges or values, or ranges or values larger or smaller by several (5, 4, 3, 2, or 1) amino acids, at either extreme or at both extremes. Polynucleotides encoding these polypeptide fragments are also encompassed by the invention.

Even if deletion of one or more amino acids from the N-terminus of a protein results in modification of loss of one or more biological functions of the protein, other functional activities (e.g., biological activities, ability to multimerize, ability to bind a ligand) may still be retained. For example, the ability of shortened muteins to induce and/or bind to antibodies which recognize the complete or mature forms of the polypeptides generally will be retained when less than the majority of the residues of the complete or mature polypeptide are removed from the N-terminus. Whether a particular polypeptide lacking N-terminal residues of a complete polypeptide retains such immunologic activities can readily be determined by routine methods described herein and otherwise known in the art. It is not unlikely that a mutein with a large number of deleted N-terminal amino acid residues may retain some biological or immunogenic activities. In fact, peptides composed of as few as six amino acid residues may often evoke an immune response.

Accordingly, polypeptide fragments include the secreted protein as well as the mature form. Further preferred polypeptide fragments include the secreted protein or the mature form having a continuous series of deleted residues from the amino or the carboxy terminus, or both. For example, any number of amino acids, ranging from 1-60, can be deleted from the amino terminus of either the secreted polypeptide or the mature form. Similarly, any number of amino acids, ranging from 1-30, can be deleted from the carboxy terminus of the secreted protein or mature form. Furthermore, any combination of the above amino and carboxy terminus deletions are preferred. Similarly, polynucleotides encoding these polypeptide fragments are also preferred.

The present invention further provides polypeptides having one or more residues deleted from the amino terminus of the amino acid sequence of a polypeptide disclosed herein (e.g., a polypeptide of SEQ ID NO:Y, a polypeptide as defined in columns 14 and 15 of Table 1A, a polypeptide encoded by the polynucleotide sequence contained in SEQ ID NO:X or the complement thereof, a polypeptide encoded by the portion of SEQ ID NO:X as defined in columns 8 and 9 of Table 2, a polypeptide encoded by the portion of SEQ ID NO:B as defined in column 6 of Table 1C, a polypeptide encoded by the cDNA contained in ATCC™ Deposit No:Z, and/or a mature polypeptide encoded by the cDNA contained in ATCC™ Deposit No:Z). In particular, N-terminal deletions may be described by the general formula m-q, where q is a whole integer representing the total number of amino acid residues in a polypeptide of the invention (e.g., the polypeptide disclosed in SEQ ID NO:Y, the mature (secreted) portion of SEQ ID NO:Y as defined in columns 14 and 15 of Table 1A, or the polypeptide encoded by the portion of SEQ ID NO:X as defined in columns 8 and 9 of Table 2), and m is defined as any integer ranging from 2 to q-6. Polynucleotides encoding these polypeptides are also encompassed by the invention.

The present invention further provides polypeptides having one or more residues from the carboxy terminus of the amino acid sequence of a polypeptide disclosed herein (e.g., a polypeptide of SEQ ID NO:Y, the mature (secreted) portion of SEQ ID NO:Y as defined in columns 14 and 15 of Table 1A, a polypeptide encoded by the polynucleotide sequence contained in SEQ ID NO:X, a polypeptide encoded by the portion of SEQ ID NO:X as defined in columns 8 and 9 of Table 2, a polypeptide encoded by the portion of SEQ ID NO:B as defined in column 6 of Table 1C, a polypeptide encoded by the cDNA contained in ATCC™ Deposit No:Z, and/or a mature polypeptide encoded by the cDNA contained in ATCC™ Deposit No:Z). In particular, C-terminal deletions may be described by the general formula 1-n, where n is any whole integer ranging from 6 to q-1, and where n corresponds to the position of amino acid residue in a polypeptide of the invention. Polynucleotides encoding these polypeptides are also encompassed by the invention.

In addition, any of the above described N- or C-terminal deletions can be combined to produce a N- and C-terminal deleted polypeptide. The invention also provides polypeptides having one or more amino acids deleted from both the amino and the carboxyl termini, which may be described generally as having residues m-n of a polypeptide encoded by SEQ ID NO:X (e.g., including, but not limited to, the preferred polypeptide disclosed as SEQ ID NO:Y, the mature (secreted) portion of SEQ ID NO:Y as defined in columns 14 and 15 of Table 1A, and the polypeptide encoded by the portion of SEQ ID NO:X as defined in columns 8 and 9 of Table 2), the cDNA contained in ATCC™ Deposit No:Z, and/or the complement thereof, where n and m are integers as described above. Polynucleotides encoding these polypeptides are also encompassed by the invention.

Also as mentioned above, even if deletion of one or more amino acids from the C-terminus of a protein results in modification of loss of one or more biological functions of the protein, other functional activities (e.g., biological activities, ability to multimerize, ability to bind a ligand) may still be retained. For example the ability of the shortened mutein to induce and/or bind to antibodies which recognize the complete or mature forms of the polypeptide generally will be retained when less than the majority of the residues of the complete or mature polypeptide are removed from the C-terminus. Whether a particular polypeptide lacking C-terminal residues of a complete polypeptide retains such immunologic activities can readily be determined by routine methods described herein and otherwise known in the art. It is not unlikely that a mutein with a large number of deleted C-terminal amino acid residues may retain some biological or immunogenic activities. In fact, peptides composed of as few as six amino acid residues may often evoke an immune response.

The present application is also directed to proteins containing polypeptides at least 80%, 85%, 90%, 95%, 96%, 97%, 98% or 99% identical to a polypeptide sequence set forth herein. In preferred embodiments, the application is directed to proteins containing polypeptides at least 80%, 85%, 90%, 95%, 96%, 97%, 98% or 99% identical to polypeptides having the amino acid sequence of the specific N- and C-terminal deletions. Polynucleotides encoding these polypeptides are also encompassed by the invention.

Any polypeptide sequence encoded by, for example, the polynucleotide sequences set forth as SEQ ID NO:X or the complement thereof, (presented, for example, in Tables 1A and 2), the cDNA contained in ATCC™ Deposit No:Z, or the polynucleotide sequence as defined in column 6 of Table 1C, may be analyzed to determine certain preferred regions of the polypeptide. For example, the amino acid sequence of a polypeptide encoded by a polynucleotide sequence of SEQ ID NO:X (e.g., the polypeptide of SEQ ID NO:Y and the polypeptide encoded by the portion of SEQ ID NO:X as defined in columns 8 and 9 of Table 2) or the cDNA contained in ATCC™ Deposit No:Z may be analyzed using the default parameters of the DNASTAR computer algorithm (DNASTAR, Inc., 1228 S. Park St., Madison, Wis. 53715 USA; www.dnastar.com/).

Polypeptide regions that may be routinely obtained using the DNASTAR computer algorithm include, but are not limited to, Garnier-Robson alpha-regions, beta-regions, turn-regions, and coil-regions; Chou-Fasman alpha-regions, beta-regions, and turn-regions; Kyte-Doolittle hydrophilic regions and hydrophobic regions; Eisenberg alpha- and beta-amphipathic regions; Karplus-Schulz flexible regions; Emini surface-forming regions; and Jameson-Wolf regions of high antigenic index. Among highly preferred polynucleotides of the invention in this regard are those that encode polypeptides comprising regions that combine several structural features, such as several (e.g., 1, 2, 3 or 4) of the features set out above.

Additionally, Kyte-Doolittle hydrophilic regions and hydrophobic regions, Emini surface-forming regions, and Jameson-Wolf regions of high antigenic index (i.e., containing four or more contiguous amino acids having an antigenic index of greater than or equal to 1.5, as identified using the default parameters of the Jameson-Wolf program) can routinely be used to determine polypeptide regions that exhibit a high degree of potential for antigenicity. Regions of high antigenicity are determined from data by DNASTAR analysis by choosing values which represent regions of the polypeptide which are likely to be exposed on the surface of the polypeptide in an environment in which antigen recognition may occur in the process of initiation of an immune response.

Preferred polypeptide fragments of the invention are fragments comprising, or alternatively, consisting of, an amino acid sequence that displays a functional activity (e.g. biological activity) of the polypeptide sequence of which the amino acid sequence is a fragment. By a polypeptide displaying a "functional activity" is meant a polypeptide capable of one or more known functional activities associated with a full-length protein, such as, for example, biological activity, antigenicity, immunogenicity, and/or multimerization, as described herein.

Other preferred polypeptide fragments are biologically active fragments. Biologically active fragments are those exhibiting activity similar, but not necessarily identical, to an activity of the polypeptide of the present invention. The biological activity of the fragments may include an improved desired activity, or a decreased undesirable activity.

In preferred embodiments, polypeptides of the invention comprise, or alternatively consist of, one, two, three, four, five or more of the antigenic fragments of the polypeptide of SEQ ID NO:Y, or portions thereof. Polynucleotides encoding these polypeptides are also encompassed by the invention.

Epitopes and Antibodies

The present invention encompasses polypeptides comprising, or alternatively consisting of, an epitope of: the polypeptide sequence shown in SEQ ID NO:Y; a polypeptide sequence encoded by SEQ ID NO:X or the complementary strand thereto; the polypeptide sequence encoded by the portion of SEQ ID NO:X as defined in columns 8 and 9 of Table 2; the polypeptide sequence encoded by the portion of SEQ ID NO:B as defined in column 6 of Table 1C or the complement thereto; the polypeptide sequence encoded by the cDNA contained in ATCC™ Deposit No:Z; or the polypeptide sequence encoded by a polynucleotide that hybridizes to the sequence of SEQ ID NO:X, the complement of the sequence of SEQ ID NO:X, the complement of a portion of SEQ ID NO:X as defined in columns 8 and 9 of Table 2, or the cDNA sequence contained in ATCC™ Deposit No:Z under stringent hybridization conditions or alternatively, under lower stringency hybridization as defined supra. The present invention further encompasses polynucleotide sequences encoding an epitope of a polypeptide sequence of the invention (such as, for example, the sequence disclosed in SEQ ID NO:X, or a fragment thereof), polynucleotide sequences of the complementary strand of a polynucleotide sequence encoding an epitope of the invention, and polynucleotide sequences which hybridize to the complementary strand under stringent hybridization conditions or alternatively, under lower stringency hybridization conditions defined supra.

The term "epitopes," as used herein, refers to portions of a polypeptide having antigenic or immunogenic activity in an animal, preferably a mammal, and most preferably in a human. In a preferred embodiment, the present invention encompasses a polypeptide comprising an epitope, as well as the polynucleotide encoding this polypeptide. An "immunogenic epitope," as used herein, is defined as a portion of a protein that elicits an antibody response in an animal, as determined by any method known in the art, for example, by the methods for generating antibodies described infra. (See, for example, Geysen et al., Proc. Natl. Acad. Sci. USA 81:3998-4002 (1983)). The term "antigenic epitope," as used herein, is defined as a portion of a protein to which an antibody can immunospecifically bind its antigen as determined by any method well known in the art, for example, by the immunoassays described herein. Immunospecific binding excludes non-specific binding but does not necessarily exclude cross-reactivity with other antigens. Antigenic epitopes need not necessarily be immunogenic.

Fragments which function as epitopes may be produced by any conventional means. (See, e.g., Houghten, R. A., Proc. Natl. Acad. Sci. USA 82:5131-5135 (1985) further described in U.S. Pat. No. 4,631,211.)

In the present invention, antigenic epitopes preferably contain a sequence of at least 4, at least 5, at least 6, at least 7, more preferably at least 8, at least 9, at least 10, at least 11, at least 12, at least 13, at least 14, at least 15, at least 20, at least 25, at least 30, at least 40, at least 50, and, most preferably, between about 15 to about 30 amino acids. Preferred polypeptides comprising immunogenic or antigenic epitopes are at least 10, 15, 20, 25, 30, 35, 40, 45, 50, 55, 60, 65, 70, 75, 80, 85, 90, 95, or 100 amino acid residues in length. Additional non-exclusive preferred antigenic epitopes include the antigenic epitopes disclosed herein, as well as portions thereof. Antigenic epitopes are useful, for example, to raise antibodies, including monoclonal antibodies, that specifically bind the epitope. Preferred antigenic epitopes include the antigenic epitopes disclosed herein, as well as any combination of two, three, four, five or more of these antigenic epitopes. Antigenic epitopes can be used as the target molecules in immunoassays. (See, for instance, Wilson et al., Cell 37:767-778 (1984); Sutcliffe et al., Science 219:660-666 (1983)).

Non-limiting examples of epitopes of polypeptides that can be used to generate antibodies of the invention include a polypeptide comprising, or alternatively consisting of, at least one, two, three, four, five, six or more of the portion(s) of SEQ ID NO:Y specified in column 6 of Table 1B.1. These polypeptide fragments have been determined to bear antigenic epitopes of the proteins of the invention by the analysis of the Jameson-Wolf antigenic index which is included in the DNAStar suite of computer programs. By "comprise" it is intended that a polypeptide contains at least one, two, three, four, five, six or more of the portion(s) of SEQ ID NO:Y shown in column 6 of Table 1B.1, but it may contain additional flanking residues on either the amino or carboxyl termini of the recited portion. Such additional flanking sequences are preferably sequences naturally found adjacent to the portion; i.e., contiguous sequence shown in SEQ ID NO:Y. The flanking sequence may, however, be sequences from a heterologous polypeptide, such as from another protein described herein or from a heterologous polypeptide not described herein. In particular embodiments, epitope portions of a polypeptide of the invention comprise one, two, three, or more of the portions of SEQ ID NO:Y shown in column 6 of Table 1B.1.

Similarly, immunogenic epitopes can be used, for example, to induce antibodies according to methods well known in the art. See, for instance, Sutcliffe et al., supra; Wilson et al., supra; Chow et al., Proc. Natl. Acad. Sci. USA 82:910-914; and Bittle et al., J. Gen. Virol. 66:2347-2354 (1985). Preferred immunogenic epitopes include the immunogenic epitopes disclosed herein, as well as any combination of two, three, four, five or more of these immunogenic epitopes. The polypeptides comprising one or more immunogenic epitopes may be presented for eliciting an antibody response together with a carrier protein, such as an albumin, to an animal system (such as rabbit or mouse), or, if the polypeptide is of sufficient length (at least about 25 amino acids), the polypeptide may be presented without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting).

Epitope-bearing polypeptides of the present invention may be used to induce antibodies according to methods well known in the art including, but not limited to, in vivo immunization, in vitro immunization, and phage display methods. See, e.g., Sutcliffe et al., supra; Wilson et al., supra, and Bittle et al., J. Gen. Virol., 66:2347-2354 (1985). If in vivo immunization is used, animals may be immunized with free peptide; however, anti-peptide antibody titer may be boosted by coupling the peptide to a macromolecular carrier, such as keyhole limpet hemacyanin (KLH) or tetanus toxoid. For instance, peptides containing cysteine residues may be coupled to a carrier using a linker such as maleimidobenzoyl-N-hydroxysuccinimide ester (MBS), while other peptides may be coupled to carriers using a more general linking agent such as glutaraldehyde. Animals such as rabbits, rats and mice are immunized with either free or carrier-coupled peptides, for instance, by intraperitoneal and/or intradermal injection of emulsions containing about 100 μg of peptide or carrier protein and Freund's adjuvant or any other adjuvant known for stimulating an immune response. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

As one of skill in the art will appreciate, and as discussed above, the polypeptides of the present invention (e.g., those comprising an immunogenic or antigenic epitope) can be fused to heterologous polypeptide sequences. For example, polypeptides of the present invention (including fragments or variants thereof), may be fused with the constant domain of immunoglobulins (IgA, IgE, IgG, IgM), or portions thereof (CH1, CH2, CH3, or any combination thereof and portions thereof, resulting in chimeric polypeptides. By way of another non-limiting example, polypeptides and/or antibodies of the present invention (including fragments or variants thereof) may be fused with albumin (including but not limited to recombinant human serum albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)). In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP Patent 0 322 094) which is herein incorporated by reference in its entirety. In another preferred embodiment, polypeptides and/or antibodies of the present invention (including fragments or variants thereof) are fused with polypeptide fragments comprising, or alternatively consisting of, amino acid residues 1-z of human serum albumin, where z is an integer from 369 to 419, as described in U.S. Pat. No. 5,766,883 herein incorporated by reference in its entirety. Polypeptides and/or antibodies of the present invention (including fragments or variants thereof) may be fused to either the N- or C-terminal end of the heterologous protein (e.g., immunoglobulin Fc polypeptide or human serum albumin polypeptide). Polynucleotides encoding fusion proteins of the invention are also encompassed by the invention.

Such fusion proteins as those described above may facilitate purification and may increase half-life in vivo. This has been shown for chimeric proteins consisting of the first two domains of the human CD4-polypeptide and various domains of the constant regions of the heavy or light chains of mammalian immunoglobulins. See, e.g., EP 394,827; Traunecker et al., Nature, 331:84-86 (1988). Enhanced delivery of an antigen across the epithelial barrier to the immune system has been demonstrated for antigens (e.g., insulin) conjugated to an FcRn binding partner such as IgG or Fc fragments (see, e.g., PCT Publications WO 96/22024 and WO 99/04813). IgG fusion proteins that have a disulfide-linked dimeric structure due to the IgG portion desulfide bonds have also been found to be more efficient in binding and neutralizing other molecules than monomeric polypeptides or fragments thereof alone. See, e.g., Fountoulakis et al., J. Biochem., 270:3958-3964 (1995). Nucleic acids encoding the above epitopes can also be recombined with a gene of interest as an epitope tag (e.g., the hemagglutinin (HA) tag or flag tag) to aid in detection and purification of the expressed polypeptide. For example, a system described by Janknecht et al. allows for the ready purification of non-denatured fusion proteins expressed in human cell lines (Janknecht et al., 1991, Proc. Natl. Acad. Sci. USA 88:8972-897). In this system, the gene of interest is subcloned into a vaccinia recombination plasmid such that the open reading frame of the gene is translationally fused to an amino-terminal tag consisting of six histidine residues. The tag serves as a matrix binding domain for the fusion protein. Extracts from cells infected with the recombinant vaccinia virus are loaded onto Ni2+ nitriloacetic acid-agarose column and histidine-tagged proteins can be selectively eluted with imidazole-containing buffers.

Fusion Proteins

Any polypeptide of the present invention can be used to generate fusion proteins. For example, the polypeptide of the present invention, when fused to a second protein, can be used as an antigenic tag. Antibodies raised against the polypeptide of the present invention can be used to indirectly detect the second protein by binding to the polypeptide. Moreover, because secreted proteins target cellular locations based on trafficking signals, polypeptides of the present invention which are shown to be secreted can be used as targeting molecules once fused to other proteins.

Examples of domains that can be fused to polypeptides of the present invention include not only heterologous signal sequences, but also other heterologous functional regions. The fusion does not necessarily need to be direct, but may occur through linker sequences.

In certain preferred embodiments, proteins of the invention are fusion proteins comprising an amino acid sequence that is an N and/or C-terminal deletion of a polypeptide of the invention. In preferred embodiments, the invention is directed to a fusion protein comprising an amino acid sequence that is at least 90%, 95%, 96%, 97%, 98% or 99% identical to a polypeptide sequence of the invention. Polynucleotides encoding these proteins are also encompassed by the invention.

Moreover, fusion proteins may also be engineered to improve characteristics of the polypeptide of the present invention. For instance, a region of additional amino acids, particularly charged amino acids, may be added to the N-terminus of the polypeptide to improve stability and persistence during purification from the host cell or subsequent handling and storage. Also, peptide moieties may be added to the polypeptide to facilitate purification. Such regions may be removed prior to final preparation of the polypeptide. The addition of peptide moieties to facilitate handling of polypeptides are familiar and routine techniques in the art.

As one of skill in the art will appreciate that, as discussed above, polypeptides of the present invention, and epitope-bearing fragments thereof, can be combined with heterologous polypeptide sequences. For example, the polypeptides of the present invention may be fused with heterologous polypeptide sequences, for example, the polypeptides of the present invention may be fused with the constant domain of immunoglobulins (IgA, IgE, IgG, IgM) or portions thereof (CH1, CH2, CH3, and any combination thereof, including both entire domains and portions thereof), or albumin (including, but not limited to, native or recombinant human albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)), resulting in chimeric polypeptides. For example, EP-A-O 464 533 (Canadian counterpart 2045869) discloses fusion proteins comprising various portions of constant region of immunoglobulin molecules together with another human protein or part thereof. In many cases, the Fc part in a fusion protein is beneficial in therapy and diagnosis, and thus can result in, for example, improved pharmacokinetic properties (EP-A 0232 262). Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL-5, have been fused with Fc portions for the purpose of high-throughput screening assays to identify antagonists of hIL-5. See, D. Bennett et al., J. Molecular Recognition 8:52-58 (1995); K. Johanson et al., J. Biol. Chem. 270:9459-9471 (1995).

Moreover, the polypeptides of the present invention can be fused to marker sequences, such as a polypeptide which facilitates purification of the fused polypeptide. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Another peptide tag useful for purification, the "HA" tag, corresponds to an epitope derived from the influenza hemagglutinin protein (Wilson et al., Cell 37:767 (1984)).

Additional fusion proteins of the invention may be generated through the techniques of gene-shuffling, motif-shuffling, exon-shuffling, and/or codon-shuffling (collectively referred to as "DNA shuffling"). DNA shuffling may be employed to modulate the activities of polypeptides of the invention, such methods can be used to generate polypeptides with altered activity, as well as agonists and antagonists of the polypeptides. See, generally, U.S. Pat. Nos. 5,605,793; 5,811,238; 5,830,721; 5,834,252; and 5,837,458, and Patten et al., Curr. Opinion Biotechnol. 8:724-33 (1997); Harayama, Trends Biotechnol. 16(2):76-82 (1998); Hansson, et al., J. Mol. Biol. 287:265-76 (1999); and Lorenzo and Blasco, Biotechniques 24(2):308-13 (1998) (each of these patents and publications are hereby incorporated by reference in its entirety). In one embodiment, alteration of polynucleotides corresponding to SEQ ID NO:X and the polypeptides encoded by these polynucleotides may be achieved by DNA shuffling. DNA shuffling involves the assembly of two or more DNA segments by homologous or site-specific recombination to generate variation in the polynucleotide sequence. In another embodiment, polynucleotides of the invention, or the encoded polypeptides, may be altered by being subjected to random mutagenesis by error-prone PCR, random nucleotide insertion or other methods prior to recombination. In another embodiment, one or more components, motifs, sections, parts, domains, fragments, etc., of a polynucleotide encoding a polypeptide of the invention may be recombined with one or more components, motifs, sections, parts, domains, fragments, etc. of one or more heterologous molecules.

Thus, any of these above fusions can be engineered using the polynucleotides or the polypeptides of the present invention.

Recombinant and Synthetic Production of Polypeptides of the Invention

The present invention also relates to vectors containing the polynucleotide of the present invention, host cells, and the production of polypeptides by synthetic and recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides of the invention may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the *E. coli* lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418, glutamine synthase, or neomycin resistance for eukaryotic cell culture, and tetracycline, kanamycin or ampicillin resistance genes for culturing in *E. coli* and other bacteria. Representative examples of appropriate hosts include, but are not limited to, bacterial cells, such as *E. coli, Streptomyces* and *Salmonella typhimurium* cells; fungal cells, such as yeast cells (e.g., *Saccharomyces cerevisiae* or *Pichia pastoris* (ATCC™ Accession No. 201178)); insect cells such as *Drosophila* S2 and *Spodoptera* Sf9 cells; animal cells such as CHO, COS, 293, and Bowes melanoma cells; and plant cells. Appropriate culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNH8A, pNH16a, pNH18A, pNH46A, available from Stratagene Cloning Systems, Inc.; and ptrc99a, pKK223-3, pKK233-3, pDR540, pRIT5 available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Preferred expression vectors for use in yeast systems include, but are not limited to pYES2, pYD1, pTEF1/Zeo, pYES2/GS, pPICZ, pGAPZ, pGAPZalph, pPIC9, pPIC3.5, pHIL-D2, pHIL-S1, pPIC3.5K, pPIC9K, and PAO815 (all available from Invitrogen, Carlbad, Calif.). Other suitable vectors will be readily apparent to the skilled artisan.

Vectors which use glutamine synthase (GS) or DHFR as the selectable markers can be amplified in the presence of the drugs methionine sulphoximine or methotrexate, respectively. An advantage of glutamine synthase based vectors are the availability of cell lines (e.g., the murine myeloma cell line, NS0) which are glutamine synthase negative. Glutamine synthase expression systems can also function in glutamine synthase expressing cells (e.g., Chinese Hamster Ovary (CHO) cells) by providing additional inhibitor to prevent the functioning of the endogenous gene. A glutamine synthase expression system and components thereof are detailed in PCT publications: WO87/04462; WO86/05807; WO89/01036; WO89/10404; and WO91/06657, which are hereby incorporated in their entireties by reference herein. Additionally, glutamine synthase expression vectors can be obtained from Lonza Biologics, Inc. (Portsmouth, N.H.). Expression and production of monoclonal antibodies using a GS expression system in murine myeloma cells is described in Bebbington et al., *Bio/technology* 10:169(1992) and in Biblia and Robinson *Biotechnol. Prog.* 11:1 (1995) which are herein incorporated by reference.

The present invention also relates to host cells containing the above-described vector constructs described herein, and additionally encompasses host cells containing nucleotide sequences of the invention that are operably associated with one or more heterologous control regions (e.g., promoter and/or enhancer) using techniques known of in the art. The host cell can be a higher eukaryotic cell, such as a mammalian cell (e.g., a human derived cell), or a lower eukaryotic cell, such as a yeast cell, or the host cell can be a prokaryotic cell, such as a bacterial cell. A host strain may be chosen which modulates the expression of the inserted gene sequences, or modifies and processes the gene product in the specific fashion desired. Expression from certain promoters can be elevated in the presence of certain inducers; thus expression of the genetically engineered polypeptide may be controlled. Furthermore, different host cells have characteristics and specific mechanisms for the translational and post-translational processing and modification (e.g., phosphorylation, cleavage) of proteins. Appropriate cell lines can be chosen to ensure the desired modifications and processing of the foreign protein expressed.

Introduction of the nucleic acids and nucleic acid constructs of the invention into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

In addition to encompassing host cells containing the vector constructs discussed herein, the invention also encompasses primary, secondary, and immortalized host cells of vertebrate origin, particularly mammalian origin, that have been engineered to delete or replace endogenous genetic material (e.g., the coding sequence), and/or to include genetic material (e.g., heterologous polynucleotide sequences) that is operably associated with polynucleotides of the invention, and which activates, alters, and/or amplifies endogenous polynucleotides. For example, techniques known in the art may be used to operably associate heterologous control regions (e.g., promoter and/or enhancer) and endogenous polynucleotide sequences via homologous recombination (see, e.g., U.S. Pat. No. 5,641,670, issued Jun. 24, 1997; International Publication Number WO 96/29411; International Publication Number WO 94/12650; Koller et al., *Proc. Natl. Acad. Sci. USA* 86:8932-8935 (1989); and Zijlstra et al., *Nature* 342:435-438 (1989), the disclosures of each of which are incorporated by reference in their entireties).

Polypeptides of the invention can be recovered and purified from the recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

Polypeptides of the present invention can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast, higher plant, insect, and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

In one embodiment, the yeast *Pichia pastoris* is used to express polypeptides of the invention in a eukaryotic system. *Pichia pastoris* is a methylotrophic yeast which can metabolize methanol as its sole carbon source. A main step in the methanol metabolization pathway is the oxidation of methanol to formaldehyde using $O_2$. This reaction is catalyzed by the enzyme alcohol oxidase. In order to metabolize methanol as its sole carbon source, *Pichia pastoris* must generate high levels of alcohol oxidase due, in part, to the relatively low affinity of alcohol oxidase for $O_2$. Consequently, in a growth medium depending on methanol as a main carbon source, the promoter region of one of the two alcohol oxidase genes (AOX1) is highly active. In the presence of methanol, alcohol oxidase produced from the AOX1 gene comprises up to approximately 30% of the total soluble protein in *Pichia pastoris*. See Ellis, S. B., et al., *Mol. Cell. Biol.* 5:1111-21 (1985); Koutz, P. J, et al., *Yeast* 5:167-77 (1989); Tschopp, J. F., et al., *Nucl. Acids Res.* 15:3859-76 (1987). Thus, a heterologous coding sequence, such as, for example, a polynucleotide of the present invention, under the transcriptional regulation of all or part of the AOX1 regulatory sequence is expressed at exceptionally high levels in *Pichia* yeast grown in the presence of methanol.

In one example, the plasmid vector pPIC9K is used to express DNA encoding a polypeptide of the invention, as set forth herein, in a *Pichea* yeast system essentially as described in "*Pichia* Protocols: Methods in Molecular Biology," D. R. Higgins and J. Cregg, eds. The Humana Press, Totowa, N.J., 1998. This expression vector allows expression and secretion of a polypeptide of the invention by virtue of the strong AOX1 promoter linked to the *Pichia pastoris* alkaline phosphatase (PHO) secretory signal peptide (i.e., leader) located upstream of a multiple cloning site.

Many other yeast vectors could be used in place of pPIC9K, such as, pYES2, pYD1, pTEF1/Zeo, pYES2/GS, pPICZ, pGAPZ, pGAPZalpha, pPIC9, pPIC3.5, pHIL-D2, pHIL-S1, pPIC3.5K, and PAO815, as one skilled in the art would readily appreciate, as long as the proposed expression construct provides appropriately located signals for transcription, translation, secretion (if desired), and the like, including an in-frame AUG as required.

In another embodiment, high-level expression of a heterologous coding sequence, such as, for example, a polynucleotide of the present invention, may be achieved by cloning the heterologous polynucleotide of the invention into an expression vector such as, for example, pGAPZ or pGAPZalpha, and growing the yeast culture in the absence of methanol.

In addition to encompassing host cells containing the vector constructs discussed herein, the invention also encompasses primary, secondary, and immortalized host cells of vertebrate origin, particularly mammalian origin, that have been engineered to delete or replace endogenous genetic material (e.g., coding sequence), and/or to include genetic material (e.g., heterologous polynucleotide sequences) that is operably associated with polynucleotides of the invention, and which activates, alters, and/or amplifies endogenous polynucleotides. For example, techniques known in the art may be used to operably associate heterologous control regions (e.g., promoter and/or enhancer) and endogenous polynucleotide sequences via homologous recombination (see, e.g., U.S. Pat. No. 5,641,670, issued Jun. 24, 1997; International Publication No. WO 96/29411, published Sep. 26, 1996; International Publication No. WO 94/12650, published Aug. 4, 1994; Koller et al., Proc. Natl. Acad. Sci. USA 86:8932-8935 (1989); and Zijlstra et al., Nature 342:435-438 (1989), the disclosures of each of which are incorporated by reference in their entireties).

In addition, polypeptides of the invention can be chemically synthesized using techniques known in the art (e.g., see Creighton, 1983, Proteins: Structures and Molecular Principles, W.H. Freeman & Co., N.Y., and Hunkapiller et al., *Nature*, 310:105-111 (1984)). For example, a polypeptide corresponding to a fragment of a polypeptide can be synthesized by use of a peptide synthesizer. Furthermore, if desired, nonclassical amino acids or chemical amino acid analogs can be introduced as a substitution or addition into the polypeptide sequence. Non-classical amino acids include, but are not limited to, to the D-isomers of the common amino acids, 2,4-diaminobutyric acid, a-amino isobutyric acid, 4-aminobutyric acid, Abu, 2-amino butyric acid, g-Abu, e-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, b-alanine, fluoro-amino acids, designer amino acids such as b-methyl amino acids, Ca-methyl amino acids, Na-methyl amino acids, and amino acid analogs in general. Furthermore, the amino acid can be D (dextrorotary) or L (levorotary).

The invention encompasses polypeptides of the present invention which are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited, to specific chemical cleavage by cyanogen bromide, trypsin, chymotrypsin, papain, V8 protease, $NaBH_4$; acetylation, formylation, oxidation, reduction; metabolic synthesis in the presence of tunicamycin; etc.

Additional post-translational modifications encompassed by the invention include, for example, e.g., N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of procaryotic host cell expression. The polypeptides may also be modified with a detectable label, such as an enzymatic, fluorescent, isotopic or affinity label to allow for detection and isolation of the protein.

Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and acquorin; and examples of suitable radioactive material include iodine ($^{121}$I, $^{123}$I, $^{125}$I, $^{131}$I), carbon ($^{14}$C), sulfur ($^{35}$S), tritium ($^{3}$H), indium ($^{111}$In, $^{112}$In, $^{113m}$In, $^{115m}$In), technetium ($^{99}$Tc, $^{99m}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, and $^{97}$Ru.

In specific embodiments, a polypeptide of the present invention or fragment or variant thereof is attached to macrocyclic chelators that associate with radiometal ions, including but not limited to, $^{177}$Lu, $^{90}$Y, $^{166}$Ho, and $^{153}$Sm, to polypeptides. In a preferred embodiment, the radiometal ion associated with the macrocyclic chelators is $^{111}$In. In another preferred embodiment, the radiometal ion associated with the macrocyclic chelator is $^{90}$Y. In specific embodiments, the macrocyclic chelator is 1,4,7,10-tetraazacyclododecane-N, N',N'',N'''-tetraacetic acid (DOTA). In other specific embodiments, DOTA is attached to an antibody of the invention or fragment thereof via a linker molecule. Examples of linker molecules useful for conjugating DOTA to a polypeptide are commonly known in the art—see, for example, DeNardo et al., Clin Cancer Res. 4(10):2483-90 (1998); Peterson et al., Bioconjug. Chem. 10(4):553-7 (1999); and Zimmerman et al, Nucl. Med. Biol. 26(8):943-50 (1999); which are hereby incorporated by reference in their entirety.

As mentioned, the proteins of the invention may be modified by either natural processes, such as posttranslational processing, or by chemical modification techniques which are well known in the art. It will be appreciated that the same type of modification may be present in the same or varying degrees at several sites in a given polypeptide. Polypeptides of the invention may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W.H. Freeman and Company, New York (1993); POSTTRANSLATIONAL COVALENT MODIFICATION OF PROTEINS, B. C. Johnson, Ed., Academic Press, New York, pgs. 1-12 (1983); Seifter et al., Meth. Enzymol. 182: 626-646 (1990); Rattan et al., Ann. N.Y. Acad. Sci. 663:48-62 (1992)).

Also provided by the invention are chemically modified derivatives of the polypeptides of the invention which may provide additional advantages such as increased solubility, stability and circulating time of the polypeptide, or decreased immunogenicity (see U.S. Pat. No. 4,179,337). The chemical moieties for derivitization may be selected from water soluble polymers such as polyethylene glycol, ethylene glycol/propylene glycol copolymers, carboxymethylcellulose, dextran, polyvinyl alcohol and the like. The polypeptides may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 45,000, 50,000, 55,000, 60,000, 65,000, 70,000, 75,000, 80,000, 85,000, 90,000, 95,000, or 100,000 kDa.

As noted above, the polyethylene glycol may have a branched structure. Branched polyethylene glycols are described, for example, in U.S. Pat. No. 5,643,575; Morpurgo et al., *Appl. Biochem. Biotechnol.* 56:59-72 (1996); Vorobjev et al., *Nucleosides Nucleotides* 18:2745-2750 (1999); and Caliceti et al., *Bioconjug. Chem.* 10:638-646 (1999), the disclosures of each of which are incorporated herein by reference.

The polyethylene glycol molecules (or other chemical moieties) should be attached to the protein with consideration of effects on functional or antigenic domains of the protein. There are a number of attachment methods available to those skilled in the art, such as, for example, the method disclosed in EP 0 401 384 (coupling PEG to G-CSF), herein incorporated by reference; see also Malik et al., Exp. Hematol. 20:1028-1035 (1992), reporting pegylation of GM-CSF using tresyl chloride. For example, polyethylene glycol may be covalently bound through amino acid residues via a reactive group, such as a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to proteins via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) of the protein or to more than one type of amino acid residue (e.g., lysine, histidine, aspartic acid, glutamic acid, cysteine and combinations thereof) of the protein.

One may specifically desire proteins chemically modified at the N-terminus. Using polyethylene glycol as an illustration of the present composition, one may select from a variety of polyethylene glycol molecules (by molecular weight, branching, etc.), the proportion of polyethylene glycol molecules to protein (polypeptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus modification may be accomplished by reductive alkylation which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achieved.

As indicated above, pegylation of the proteins of the invention may be accomplished by any number of means. For example, polyethylene glycol may be attached to the protein either directly or by an intervening linker. Linkerless systems for attaching polyethylene glycol to proteins are described in Delgado et al., Crit. Rev. Thera. Drug Carrier Sys. 9:249-304 (1992); Francis et al., Intern. J. of Hematol. 68:1-18 (1998); U.S. Pat. No. 4,002,531; U.S. Pat. No. 5,349,052; WO 95/06058; and WO 98/32466, the disclosures of each of which are incorporated herein by reference.

One system for attaching polyethylene glycol directly to amino acid residues of proteins without an intervening linker employs tresylated MPEG, which is produced by the modification of monmethoxy polyethylene glycol (MPEG) using tresylchloride ($ClSO_2CH_2CF_3$). Upon reaction of protein with tresylated MPEG, polyethylene glycol is directly attached to amine groups of the protein. Thus, the invention includes protein-polyethylene glycol conjugates produced by reacting proteins of the invention with a polyethylene glycol molecule having a 2,2,2-trifluoreothane sulphonyl group.

Polyethylene glycol can also be attached to proteins using a number of different intervening linkers. For example, U.S. Pat. No. 5,612,460, the entire disclosure of which is incorporated herein by reference, discloses urethane linkers for connecting polyethylene glycol to proteins. Protein-polyethylene glycol conjugates wherein the polyethylene glycol is attached to the protein by a linker can also be produced by reaction of proteins with compounds such as MPEG-succinimidylsuccinate, MPEG activated with 1,1'-carbonyldiimidazole, MPEG-2,4,5-trichloropenylcarbonate, MPEG-p-nitrophenolcarbonate, and various MPEG-succinate derivatives. A number of additional polyethylene glycol derivatives and reaction chemistries for attaching polyethylene glycol to proteins are described in International Publication No. WO 98/32466, the entire disclosure of which is incorporated herein by reference. Pegylated protein products produced using the reaction chemistries set out herein are included within the scope of the invention.

The number of polyethylene glycol moieties attached to each protein of the invention (i.e., the degree of substitution) may also vary. For example, the pegylated proteins of the invention may be linked, on average, to 1, 2, 3, 4, 5, 6, 7, 8, 9, 10, 12, 15, 17, 20, or more polyethylene glycol molecules. Similarly, the average degree of substitution within ranges such as 1-3, 2-4, 3-5, 4-6, 5-7, 6-8, 7-9, 8-10, 9-11, 10-12, 11-13, 12-14, 13-15, 14-16, 15-17, 16-18, 17-19, or 18-20 polyethylene glycol moieties per protein molecule. Methods for determining the degree of substitution are discussed, for example, in Delgado et al., Crit. Rev. Thera. Drug Carrier Sys. 9:249-304 (1992).

The polypeptides of the invention can be recovered and purified from chemical synthesis and recombinant cell cultures by standard methods which include, but are not limited to, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification. Well known techniques for refolding protein may be employed to regenerate active conformation when the polypeptide is denatured during isolation and/or purification.

The polypeptides of the invention may be in monomers or multimers (i.e., dimers, trimers, tetramers and higher multimers). Accordingly, the present invention relates to monomers and multimers of the polypeptides of the invention, their preparation, and compositions (preferably, Therapeutics) containing them. In specific embodiments, the polypeptides of the invention are monomers, dimers, trimers or tetramers. In additional embodiments, the multimers of the invention are at least dimers, at least trimers, or at least tetramers.

Multimers encompassed by the invention may be homomers or heteromers. As used herein, the term homomer refers to a multimer containing only polypeptides corresponding to a protein of the invention (e.g., the amino acid sequence of SEQ ID NO:Y, an amino acid sequence encoded by SEQ ID NO:X or the complement of SEQ ID NO:X, the amino acid sequence encoded by the portion of SEQ ID NO:X as defined in columns 8 and 9 of Table 2, and/or an amino acid sequence encoded by cDNA contained in ATCC™ Deposit No:Z (including fragments, variants, splice variants, and fusion proteins, corresponding to these as described herein)). These homomers may contain polypeptides having identical or different amino acid sequences. In a specific embodiment, a homomer of the invention is a multimer containing only polypeptides having an identical amino acid sequence. In another specific embodiment, a homomer of the invention is a multimer containing polypeptides having different amino acid sequences. In specific embodiments, the multimer of the invention is a homodimer (e.g., containing two polypeptides having identical or different amino acid sequences) or a homotrimer (e.g., containing three polypeptides having identical and/or different amino acid sequences). In additional embodiments, the homomeric multimer of the invention is at least a homodimer, at least a homotrimer, or at least a homotetramer.

As used herein, the term heteromer refers to a multimer containing one or more heterologous polypeptides (i.e., polypeptides of different proteins) in addition to the polypeptides of the invention. In a specific embodiment, the multimer of the invention is a heterodimer, a heterotrimer, or a heterotetramer. In additional embodiments, the heteromeric multimer of the invention is at least a heterodimer, at least a heterotrimer, or at least a heterotetramer.

Multimers of the invention may be the result of hydrophobic, hydrophilic, ionic and/or covalent associations and/or may be indirectly linked by, for example, liposome formation. Thus, in one embodiment, multimers of the invention, such as, for example, homodimers or homotrimers, are formed when polypeptides of the invention contact one another in solution. In another embodiment, heteromultimers of the invention, such as, for example, heterotrimers or heterotetramers, are formed when polypeptides of the invention contact antibodies to the polypeptides of the invention (including antibodies to the heterologous polypeptide sequence in a fusion protein of the invention) in solution. In other embodiments, multimers of the invention are formed by covalent associations with and/or between the polypeptides of the invention. Such covalent associations may involve one or more amino acid residues contained in the polypeptide sequence (e.g., that recited in SEQ ID NO:Y, encoded by the portion of SEQ ID NO:X as defined in columns 8 and 9 of Table 2, and/or encoded by the cDNA contained in ATCC™ Deposit No:Z). In one instance, the covalent associations are cross-linking between cysteine residues located within the polypeptide sequences which interact in the native (i.e., naturally occurring) polypeptide. In another instance, the covalent associations are the consequence of chemical or recombinant manipulation. Alternatively, such covalent associations may involve one or more amino acid residues contained in the heterologous polypeptide sequence in a fusion protein. In one example, covalent associations are between the heterologous sequence contained in a fusion protein of the invention (see, e.g., U.S. Pat. No. 5,478,925). In a specific example, the covalent associations are between the heterologous sequence contained in a Fc fusion protein of the invention (as described herein). In another specific example, covalent associations of fusion proteins of the invention are between heterologous polypeptide sequence from another protein that is capable of forming covalently associated multimers, such as for example, osteoprotegerin (see, e.g., International Publication NO: WO 98/49305, the contents of which are herein incorporated by reference in its entirety). In another embodiment, two or more polypeptides of the invention are joined through peptide linkers. Examples include those peptide linkers described in U.S. Pat. No. 5,073,627 (hereby incorporated by reference). Proteins comprising multiple polypeptides of the invention separated by peptide linkers may be produced using conventional recombinant DNA technology.

Another method for preparing multimer polypeptides of the invention involves use of polypeptides of the invention fused to a leucine zipper or isoleucine zipper polypeptide sequence. Leucine zipper and isoleucine zipper domains are polypeptides that promote multimerization of the proteins in which they are found. Leucine zippers were originally identified in several DNA-binding proteins (Landschulz et al., Science 240:1759, (1988)), and have since been found in a variety of different proteins. Among the known leucine zippers are naturally occurring peptides and derivatives thereof that dimerize or trimerize. Examples of leucine zipper domains suitable for producing soluble multimeric proteins of the invention are those described in PCT application WO 94/10308, hereby incorporated by reference. Recombinant fusion proteins comprising a polypeptide of the invention fused to a polypeptide sequence that dimerizes or trimerizes in solution are expressed in suitable host cells, and the resulting soluble multimeric fusion protein is recovered from the culture supernatant using techniques known in the art.

Trimeric polypeptides of the invention may offer the advantage of enhanced biological activity. Preferred leucine zipper moieties and isoleucine moieties are those that preferentially form trimers. One example is a leucine zipper derived from lung surfactant protein D (SPD), as described in Hoppe et al. (FEBS Letters 344:191, (1994)) and in U.S. patent application Ser. No. 08/446,922, hereby incorporated by reference. Other peptides derived from naturally occurring trimeric proteins may be employed in preparing trimeric polypeptides of the invention.

In another example, proteins of the invention are associated by interactions between Flag® polypeptide sequence contained in fusion proteins of the invention containing Flag® polypeptide sequence. In a further embodiment, proteins of the invention are associated by interactions between heterologous polypeptide sequence contained in Flag® fusion proteins of the invention and anti-Flag®g antibody.

The multimers of the invention may be generated using chemical techniques known in the art. For example, polypeptides desired to be contained in the multimers of the invention may be chemically cross-linked using linker molecules and linker molecule length optimization techniques known in the art (see, e.g., U.S. Pat. No. 5,478,925, which is herein incorporated by reference in its entirety). Additionally, multimers of the invention may be generated using techniques known in the art to form one or more inter-molecule cross-links between the cysteine residues located within the sequence of the polypeptides desired to be contained in the multimer (see, e.g., U.S. Pat. No. 5,478,925, which is herein incorporated by reference in its entirety). Further, polypeptides of the invention may be routinely modified by the addition of cysteine or biotin to the C-terminus or N-terminus of the polypeptide and techniques known in the art may be applied to generate multimers containing one or more of these modified polypeptides (see, e.g., U.S. Pat. No. 5,478,925, which is herein incorporated by reference in its entirety). Additionally, techniques known in the art may be applied to generate liposomes containing the polypeptide components desired to be contained in the multimer of the invention (see, e.g., U.S. Pat. No. 5,478,925, which is herein incorporated by reference in its entirety).

Alternatively, multimers of the invention may be generated using genetic engineering techniques known in the art. In one embodiment, polypeptides contained in multimers of the invention are produced recombinantly using fusion protein technology described herein or otherwise known in the art (see, e.g., U.S. Pat. No. 5,478,925, which is herein incorporated by reference in its entirety). In a specific embodiment, polynucleotides coding for a homodimer of the invention are generated by ligating a polynucleotide sequence encoding a polypeptide of the invention to a sequence encoding a linker polypeptide and then further to a synthetic polynucleotide encoding the translated product of the polypeptide in the reverse orientation from the original C-terminus to the N-terminus (lacking the leader sequence) (see, e.g., U.S. Pat. No. 5,478,925, which is herein incorporated by reference in its entirety). In another embodiment, recombinant techniques described herein or otherwise known in the art are applied to generate recombinant polypeptides of the invention which contain a transmembrane domain (or hydrophobic or signal peptide) and which can be incorporated by membrane reconstitution techniques into liposomes (see, e.g., U.S. Pat. No. 5,478,925, which is herein incorporated by reference in its entirety).

Antibodies

Further polypeptides of the invention relate to antibodies and T-cell antigen receptors (TCR) which immunospecifically bind a polypeptide, polypeptide fragment, or variant of the invention (e.g., a polypeptide or fragment or variant of the amino acid sequence of SEQ ID NO:Y or a polypeptide encoded by the cDNA contained in ATCC™ Deposit No:Z, and/or an epitope, of the present invention) as determined by immunoassays well known in the art for assaying specific antibody-antigen binding. Antibodies of the invention include, but are not limited to, polyclonal, monoclonal, multispecific, human, humanized or chimeric antibodies, single chain antibodies, Fab fragments, F(ab') fragments, fragments produced by a Fab expression library, anti-idiotypic (anti-Id) antibodies (including, e.g., anti-Id antibodies to antibodies of the invention), intracellularly-made antibodies (i.e., intrabodies), and epitope-binding fragments of any of the above. The term "antibody," as used herein, refers to immunoglobulin molecules and immunologically active portions of immunoglobulin molecules, i.e., molecules that contain an antigen binding site that immunospecifically binds an antigen. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule. In preferred embodiments, the immunoglobulin molecules of the invention are IgG1. In other preferred embodiments, the immunoglobulin molecules of the invention are IgG4.

Most preferably the antibodies are human antigen-binding antibody fragments of the present invention and include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. The antibodies of the invention may be from any animal origin including birds and mammals. Preferably, the antibodies are human, murine (e.g., mouse and rat), donkey, ship rabbit, goat, guinea pig, camel, horse, or chicken. As used herein, "human" antibodies include antibodies having the amino acid sequence of a human immunoglobulin and include antibodies isolated from human immunoglobulin libraries or from animals transgenic for one or more human immunoglobulin and that do not express endogenous immunoglobulins, as described infra and, for example in, U.S. Pat. No. 5,939,598 by Kucherlapati et al. The antibodies of the present invention may be monospecific, bispecific, trispecific or of greater multispecificity. Multispecific antibodies may be specific for different epitopes of a polypeptide of the present invention or may be specific for both a polypeptide of the present invention as well as for a heterologous epitope, such as a heterologous polypeptide or solid support material. See, e.g., PCT publications WO 93/17715; WO 92/08802; WO 91/00360; WO 92/05793; Tutt, et al., J. Immunol. 147:60-69 (1991); U.S. Pat. Nos. 4,474,893; 4,714,681; 4,925,648; 5,573,920; 5,601,819; Kostelny et al., J. Immunol. 148:1547-1553 (1992).

Antibodies of the present invention may be described or specified in terms of the epitope(s) or portion(s) of a polypeptide of the present invention which they recognize or specifically bind. The epitope(s) or polypeptide portion(s) may be specified as described herein, e.g., by N-terminal and C-terminal positions, or by size in contiguous amino acid residues, or listed in the Tables and Figures. Preferred epitopes of the invention include the predicted epitopes shown in column 6 of Table 1B.1, as well as polynucleotides that encode these epitopes. Antibodies which specifically bind any epitope or polypeptide of the present invention may also be excluded. Therefore, the present invention includes antibodies that specifically bind polypeptides of the present invention, and allows for the exclusion of the same.

Antibodies of the present invention may also be described or specified in terms of their cross-reactivity. Antibodies that do not bind any other analog, ortholog, or homolog of a polypeptide of the present invention are included. Antibodies that bind polypeptides with at least 95%, at least 90%, at least 85%, at least 80%, at least 75%, at least 70%, at least 65%, at least 60%, at least 55%, and at least 50% identity (as calculated using methods known in the art and described herein) to a polypeptide of the present invention are also included in the present invention. In specific embodiments, antibodies of the present invention cross-react with murine, rat and/or rabbit homologs of human proteins and the corresponding epitopes thereof. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. In a specific embodiment, the above-described cross-reactivity is with respect to any single specific antigenic or immunogenic polypeptide, or combination(s) of 2, 3, 4, 5, or more of the specific antigenic and/or immunogenic polypeptides disclosed herein. Further included in the present invention are antibodies which bind polypeptides encoded by polynucleotides which hybridize to a polynucleotide of the present invention under stringent hybridization conditions (as described herein). Antibodies of the present invention may also be described or specified in terms of their binding affinity to a polypeptide of the invention. Preferred binding affinities include those with a dissociation constant or Kd less than $5\times10^{-2}$ M, $10^{-2}$ M, $5\times10^{-3}$ M, $10^{-3}$ M, $5\times10^{-4}$ M, $10^{-4}$ M, $5\times10^{-5}$ M, $10^{-5}$ M, $5\times10^{-6}$ M, $10^{-6}$M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10^{-15}$ M, or $10^{-15}$ M.

The invention also provides antibodies that competitively inhibit binding of an antibody to an epitope of the invention as determined by any method known in the art for determining competitive binding, for example, the immunoassays described herein. In preferred embodiments, the antibody competitively inhibits binding to the epitope by at least 95%, at least 90%, at least 85%, at least 80%, at least 75%, at least 70%, at least 60%, or at least 50%.

Antibodies of the present invention may act as agonists or antagonists of the polypeptides of the present invention. For example, the present invention includes antibodies which disrupt the receptor/ligand interactions with the polypeptides of the invention either partially or fully. Preferably, antibodies of the present invention bind an antigenic epitope disclosed herein, or a portion thereof. The invention features both receptor-specific antibodies and ligand-specific antibodies. The invention also features receptor-specific antibodies which do not prevent ligand binding but prevent receptor activation. Receptor activation (i.e., signaling) may be determined by techniques described herein or otherwise known in the art. For example, receptor activation can be determined by detecting the phosphorylation (e.g., tyrosine or serine/threonine) of the receptor or its substrate by immunoprecipitation followed by western blot analysis (for example, as described supra). In specific embodiments, antibodies are provided that inhibit ligand activity or receptor activity by at least 95%, at least 90%, at least 85%, at least 80%, at least 75%, at least 70%, at least 60%, or at least 50% of the activity in absence of the antibody.

The invention also features receptor-specific antibodies which both prevent ligand binding and receptor activation as well as antibodies that recognize the receptor-ligand complex, and, preferably, do not specifically recognize the unbound receptor or the unbound ligand. Likewise, included in the invention are neutralizing antibodies which bind the ligand and prevent binding of the ligand to the receptor, as well as antibodies which bind the ligand, thereby preventing receptor activation, but do not prevent the ligand from binding the receptor. Further included in the invention are antibodies which activate the receptor. These antibodies may act as receptor agonists, i.e., potentiate or activate either all or a subset of the biological activities of the ligand-mediated receptor activation, for example, by inducing dimerization of the receptor. The antibodies may be specified as agonists, antagonists or inverse agonists for biological activities comprising the specific biological activities of the peptides of the invention disclosed herein. The above antibody agonists can be made using methods known in the art. See, e.g., PCT publication WO 96/40281; U.S. Pat. No. 5,811,097; Deng et al., Blood 92(6):1981-1988 (1998); Chen et al., Cancer Res. 58(16):3668-3678 (1998); Harrop et al., J. Immunol. 161(4): 1786-1794 (1998); Zhu et al., Cancer Res. 58(15):3209-3214 (1998); Yoon et al., J. Immunol. 160(7):3170-3179 (1998); Prat et al., J. Cell. Sci. 11(Pt 2):237-247 (1998); Pitard et al., J. Immunol. Methods 205(2):177-190 (1997); Liautard et al., Cytokine 9(4):233-241 (1997); Carlson et al., J. Biol. Chem. 272(17):11295-11301 (1997); Taryman et al., Neuron 14(4): 755-762 (1995); Muller et al., Structure 6(9):1153-1167 (1998); Bartunek et al., Cytokine 8(1):14-20 (1996) (which are all incorporated by reference herein in their entireties).

Antibodies of the present invention may be used, for example, to purify, detect, and target the polypeptides of the present invention, including both in vitro and in vivo diagnostic and therapeutic methods. For example, the antibodies have utility in immunoassays for qualitatively and quantitatively measuring levels of the polypeptides of the present invention in biological samples. See, e.g., Harlow et al., Antibodies: A Laboratory Manual, (Cold Spring Harbor Laboratory Press, 2nd ed. 1988); incorporated by reference herein in its entirety.

As discussed in more detail below, the antibodies of the present invention may be used either alone or in combination with other compositions. The antibodies may further be recombinantly fused to a heterologous polypeptide at the N- or C-terminus or chemically conjugated (including covalent and non-covalent conjugations) to polypeptides or other compositions. For example, antibodies of the present invention may be recombinantly fused or conjugated to molecules useful as labels in detection assays and effector molecules such as heterologous polypeptides, drugs, radionuclides, or toxins. See, e.g., PCT publications WO 92/08495; WO 91/14438; WO 89/12624; U.S. Pat. No. 5,314,995; and EP 396,387; the disclosures of which are incorporated herein by reference in their entireties.

The antibodies of the invention include derivatives that are modified, i.e., by the covalent attachment of any type of molecule to the antibody such that covalent attachment does not prevent the antibody from generating an anti-idiotypic response. For example, but not by way of limitation, the antibody derivatives include antibodies that have been modified, e.g., by glycosylation, acetylation, pegylation, phosphylation, amidation, derivatization by known protecting/blocking groups, proteolytic cleavage, linkage to a cellular ligand or other protein, etc. Any of numerous chemical modifications may be carried out by known techniques, including, but not limited to specific chemical cleavage, acetylation, formylation, metabolic synthesis of tunicamycin, etc. Additionally, the derivative may contain one or more non-classical amino acids.

The antibodies of the present invention may be generated by any suitable method known in the art. Polyclonal antibodies to an antigen-of-interest can be produced by various procedures well known in the art. For example, a polypeptide of the invention can be administered to various host animals including, but not limited to, rabbits, mice, rats, etc. to induce the production of sera containing polyclonal antibodies specific for the antigen. Various adjuvants may be used to increase the immunological response, depending on the host species, and include but are not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and *corynebacterium parvum*. Such adjuvants are also well known in the art.

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas 563-681 (Elsevier, N.Y., 1981) (said references incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art and are discussed in detail in the Examples. In a non-limiting example, mice can be immunized with a polypeptide of the invention or a cell expressing such peptide. Once an immune response is detected, e.g., antibodies specific for the antigen are detected in the mouse serum, the mouse spleen is harvested and splenocytes isolated. The splenocytes are then fused by well known techniques to any suitable myeloma cells, for example cells from cell line SP20 available from the ATCC™. Hybridomas are selected and cloned by limited dilution. The hybridoma clones are then assayed by methods known in the art for cells that secrete antibodies capable of binding a polypeptide of the invention. Ascites fluid, which generally contains high levels of antibodies, can be generated by immunizing mice with positive hybridoma clones.

Accordingly, the present invention provides methods of generating monoclonal antibodies as well as antibodies produced by the method comprising culturing a hybridoma cell secreting an antibody of the invention wherein, preferably, the hybridoma is generated by fusing splenocytes isolated from a mouse immunized with an antigen of the invention with myeloma cells and then screening the hybridomas resulting from the fusion for hybridoma clones that secrete an antibody able to bind a polypeptide of the invention.

Another well known method for producing both polyclonal and monoclonal human B cell lines is transformation using Epstein Barr Virus (EBV). Protocols for generating EBV-transformed B cell lines are commonly known in the art, such as, for example, the protocol outlined in Chapter 7.22 of Current Protocols in Immunology, Coligan et al., Eds., 1994, John Wiley & Sons, NY, which is hereby incorporated in its entirety by reference. The source of B cells for transformation is commonly human peripheral blood, but B cells for transformation may also be derived from other sources including, but not limited to, lymph nodes, tonsil, spleen, tumor tissue, and infected tissues. Tissues are generally made into single cell suspensions prior to EBV transformation. Additionally, steps may be taken to either physically remove or inactivate T cells (e.g., by treatment with cyclosporin A) in B cell-containing samples, because T cells from individuals seropositive for anti-EBV antibodies can suppress B cell immortalization by EBV.

In general, the sample containing human B cells is innoculated with EBV, and cultured for 3-4 weeks. A typical source of EBV is the culture supernatant of the B95-8 cell line (ATCC™ #VR-1492). Physical signs of EBV transformation can generally be seen towards the end of the 3-4 week culture period. By phase-contrast microscopy, transformed cells may appear large, clear, hairy and tend to aggregate in tight clusters of cells. Initially, EBV lines are generally polyclonal. However, over prolonged periods of cell cultures, EBV lines may become monoclonal or polyclonal as a result of the selective outgrowth of particular B cell clones. Alternatively, polyclonal EBV transformed lines may be subcloned (e.g., by limiting dilution culture) or fused with a suitable fusion partner and plated at limiting dilution to obtain monoclonal B cell lines. Suitable fusion partners for EBV transformed cell lines include mouse myeloma cell lines (e.g., SP2/0, X63-Ag8.653), heteromyeloma cell lines (human×mouse; e.g., SPAM-8, SBC-H20, and CB-F7), and human cell lines (e.g., GM 1500, SKO-007, RPMI 8226, and KR-4). Thus, the present invention also provides a method of generating polyclonal or monoclonal human antibodies against polypeptides of the invention or fragments thereof, comprising EBV-transformation of human B cells.

Antibody fragments which recognize specific epitopes may be generated by known techniques. For example, Fab and F(ab')2 fragments of the invention may be produced by proteolytic cleavage of immunoglobulin molecules, using enzymes such as papain (to produce Fab fragments) or pepsin (to produce F(ab')2 fragments). F(ab')2 fragments contain the variable region, the light chain constant region and the CH1 domain of the heavy chain.

For example, the antibodies of the present invention can also be generated using various phage display methods known in the art. In phage display methods, functional antibody domains are displayed on the surface of phage particles which carry the polynucleotide sequences encoding them. In a particular embodiment, such phage can be utilized to display antigen binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., BioTechniques 12(6):864-869 (1992); and Sawai et al., AJRI 34:26-34 (1995); and Better et al., Science 240:1041-1043 (1988) (said references incorporated by reference in their entireties).

Examples of techniques which can be used to produce single-chain Fvs and antibodies include those described in U.S. Pat. Nos. 4,946,778 and 5,258,498; Huston et al., Methods in Enzymology 203:46-88 (1991); Shu et al., PNAS 90:7995-7999 (1993); and Skerra et al., Science 240:1038-1040 (1988). For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a human immunoglobulin constant region. Methods for producing chimeric antibodies are known in the art. See e.g., Morrison, Science 229:1202 (1985); Oi et al., BioTechniques 4:214 (1986); Gillies et al., (1989) J. Immunol. Methods 125:191-202; U.S. Pat. Nos. 5,807,715; 4,816,567; and 4,816,397, which are incorporated herein by reference in their entirety. Humanized antibodies are antibody molecules from non-human species antibody that binds the desired antigen having one or more complementarity determining regions (CDRs) from the non-human species and a framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., Nature 332:323 (1988), which are incorporated herein by reference in their entireties.) Antibodies can be humanized using a variety of techniques known in the art including, for example, CDR-grafting (EP 239,400; PCT publication WO 91/09967; U.S. Pat. Nos. 5,225,539; 5,530,101; and 5,585,089), veneering or resurfacing (EP 592,106; EP 519,596; Padlan, Molecular Immunology 28(4/5):489-498 (1991); Studnicka et al., Protein Engineering 7(6):805-814 (1994); Roguska. et al., PNAS 91:969-973 (1994)), and chain shuffling (U.S. Pat. No. 5,565,332).

Completely human antibodies are particularly desirable for therapeutic treatment of human patients. Human antibodies can be made by a variety of methods known in the art including phage display methods described above using antibody libraries derived from human immunoglobulin sequences. See also, U.S. Pat. Nos. 4,444,887 and 4,716,111; and PCT publications WO 98/46645, WO 98/50433, WO 98/24893, WO 98/16654, WO 96/34096, WO 96/33735, and WO 91/10741; each of which is incorporated herein by reference in its entirety.

Human antibodies can also be produced using transgenic mice which are incapable of expressing functional endogenous immunoglobulins, but which can express human immunoglobulin genes. For example, the human heavy and light chain immunoglobulin gene complexes may be introduced randomly or by homologous recombination into mouse embryonic stem cells. Alternatively, the human variable region, constant region, and diversity region may be introduced into mouse embryonic stem cells in addition to the human heavy and light chain genes. The mouse heavy and light chain immunoglobulin genes may be rendered nonfunctional separately or simultaneously with the introduction of human immunoglobulin loci by homologous recombination. In particular, homozygous deletion of the JH region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of a polypeptide of the invention. Monoclonal antibodies directed against the antigen can be obtained from the immunized, transgenic mice using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA, IgM and IgE antibodies. For an overview of this technology for producing human antibodies, see Lonberg and Huszar, Int. Rev. Immunol. 13:65-93 (1995). For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; 5,939,598; 6,075,181; and 6,114,598, which are incorporated by reference herein in their entirety. In addition, companies such as Abgenix, Inc. (Freemont, Calif.) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology 12:899-903 (1988)).

Further, antibodies to the polypeptides of the invention can, in turn, be utilized to generate anti-idiotype antibodies that "mimic" polypeptides of the invention using techniques well known to those skilled in the art. (See, e.g., Greenspan & Bona, FASEB J. 7(5):437-444; (1989) and Nissinoff, J. Immunol. 147(8):2429-2438 (1991)). For example, antibodies which bind to and competitively inhibit polypeptide multimerization and/or binding of a polypeptide of the invention to a ligand can be used to generate anti-idiotypes that "mimic" the polypeptide multimerization and/or binding domain and, as a consequence, bind to and neutralize polypeptide and/or its ligand. Such neutralizing anti-idiotypes or Fab fragments of such anti-idiotypes can be used in therapeutic regimens to neutralize polypeptide ligand(s)/receptor(s). For example, such anti-idiotypic antibodies can be used to bind a polypeptide of the invention and/or to bind its ligand(s)/receptor(s), and thereby block its biological activity. Alternatively, antibodies which bind to and enhance polypeptide multimerization and/or binding, and/or receptor/ligand multimerization, binding and/or signaling can be used to generate anti-idiotypes that function as agonists of a polypeptide of the invention and/or its ligand/receptor. Such agonistic anti-idiotypes or Fab fragments of such anti-idiotypes can be used in therapeutic regimens as agonists of the polypeptides of the invention or its ligand(s)/receptor(s). For example, such anti-idiotypic antibodies can be used to bind a polypeptide of the invention and/or to bind its ligand(s)/receptor(s), and thereby promote or enhance its biological activity.

Intrabodies of the invention can be produced using methods known in the art, such as those disclosed and reviewed in Chen et al., Hum. Gene Ther. 5:595-601 (1994); Marasco, W. A., Gene Ther. 4:11-15 (1997); Rondon and Marasco, Annu. Rev. Microbiol. 51:257-283 (1997); Proba et al., J. Mol. Biol. 275:245-253 (1998); Cohen et al., Oncogene 17:2445-2456 (1998); Ohage and Steipe, J. Mol. Biol. 291:1119-1128 (1999); Ohage et al., J. Mol. Biol. 291:1129-1134 (1999); Wirtz and Steipe, Protein Sci. 8:2245-2250 (1999); Zhu et al., J. Immunol. Methods 231:207-222 (1999); and references cited therein.

Polynucleotides Encoding Antibodies

The invention further provides polynucleotides comprising a nucleotide sequence encoding an antibody of the invention and fragments thereof. The invention also encompasses polynucleotides that hybridize under stringent or alternatively, under lower stringency hybridization conditions, e.g., as defined supra, to polynucleotides that encode an antibody, preferably, that specifically binds to a polypeptide of the invention, preferably, an antibody that binds to a polypeptide having the amino acid sequence of SEQ ID NO:Y, to a polypeptide encoded by a portion of SEQ ID NO:X as defined in columns 8 and 9 of Table 2, and/or to a polypeptide encoded by the cDNA contained in ATCC™ Deposit No:Z.

The polynucleotides may be obtained, and the nucleotide sequence of the polynucleotides determined, by any method known in the art. For example, if the nucleotide sequence of the antibody is known, a polynucleotide encoding the antibody may be assembled from chemically synthesized oligonucleotides (e.g., as described in Kutmeier et al., BioTechniques 17:242 (1994)), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody may be generated from nucleic acid from a suitable source. If a clone containing a nucleic acid encoding a particular antibody is not available, but the sequence of the antibody molecule is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from, any tissue or cells expressing the antibody, such as hybridoma cells selected to express an antibody of the invention) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence and corresponding amino acid sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate antibodies having a different amino acid sequence, for example to create amino acid substitutions, deletions, and/or insertions.

In a specific embodiment, the amino acid sequence of the heavy and/or light chain variable domains may be inspected to identify the sequences of the complementarity determining regions (CDRs) by methods that are well know in the art, e.g., by comparison to known amino acid sequences of other heavy and light chain variable regions to determine the regions of sequence hypervariability. Using routine recombinant DNA techniques, one or more of the CDRs may be inserted within framework regions, e.g., into human framework regions to humanize a non-human antibody, as described supra. The framework regions may be naturally occurring or consensus framework regions, and preferably human framework regions (see, e.g., Chothia et al., J. Mol. Biol. 278: 457-479 (1998) for a listing of human framework regions). Preferably, the polynucleotide generated by the combination of the framework regions and CDRs encodes an antibody that specifically binds a polypeptide of the invention. Preferably, as discussed supra, one or more amino acid substitutions may be made within the framework regions, and, preferably, the amino acid substitutions improve binding of the antibody to its antigen. Additionally, such methods may be used to make amino acid substitutions or deletions of one or more variable region cysteine residues participating in an intrachain disulfide bond to generate antibody molecules lacking one or more intrachain disulfide bonds. Other alterations to the polynucleotide are encompassed by the present invention and within the skill of the art.

In addition, techniques developed for the production of "chimeric antibodies" (Morrison et al., Proc. Natl. Acad. Sci. 81:851-855 (1984); Neuberger et al., Nature 312:604-608 (1984); Takeda et al., Nature 314:452-454 (1985)) by splicing genes from a mouse antibody molecule of appropriate antigen specificity together with genes from a human antibody molecule of appropriate biological activity can be used. As described supra, a chimeric antibody is a molecule in which different portions are derived from different animal species, such as those having a variable region derived from a murine mAb and a human immunoglobulin constant region, e.g., humanized antibodies.

Alternatively, techniques described for the production of single chain antibodies (U.S. Pat. No. 4,946,778; Bird, Science 242:423-42 (1988); Huston et al., Proc. Natl. Acad. Sci. USA 85:5879-5883 (1988); and Ward et al., Nature 334:544-54 (1989)) can be adapted to produce single chain antibodies. Single chain antibodies are formed by linking the heavy and light chain fragments of the Fv region via an amino acid bridge, resulting in a single chain polypeptide. Techniques for the assembly of functional Fv fragments in *E. coli* may also be used (Skerra et al., Science 242:1038-1041 (1988)).

Methods of Producing Antibodies

The antibodies of the invention can be produced by any method known in the art for the synthesis of antibodies, in particular, by chemical synthesis or preferably, by recombinant expression techniques. Methods of producing antibodies include, but are not limited to, hybridoma technology, EBV transformation, and other methods discussed herein as well as through the use recombinant DNA technology, as discussed below.

Recombinant expression of an antibody of the invention, or fragment, derivative or analog thereof, (e.g., a heavy or light chain of an antibody of the invention or a single chain antibody of the invention), requires construction of an expression vector containing a polynucleotide that encodes the antibody. Once a polynucleotide encoding an antibody molecule or a heavy or light chain of an antibody, or portion thereof (preferably containing the heavy or light chain variable domain), of the invention has been obtained, the vector for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention, or a heavy or light chain thereof, or a heavy or light chain variable domain, operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy or light chain.

The expression vector is transferred to a host cell by conventional techniques and the transfected cells are then cultured by conventional techniques to produce an antibody of the invention. Thus, the invention includes host cells containing a polynucleotide encoding an antibody of the invention, or a heavy or light chain thereof, or a single chain antibody of the invention, operably linked to a heterologous promoter. In preferred embodiments for the expression of double-chained antibodies, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include but are not limited to microorganisms such as bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

In bacterial systems, a number of expression vectors may be advantageously selected depending upon the use intended for the antibody molecule being expressed. For example, when a large quantity of such a protein is to be produced, for the generation of pharmaceutical compositions of an antibody molecule, vectors which direct the expression of high levels of fusion protein products that are readily purified may be desirable. Such vectors include, but are not limited, to the *E. coli* expression vector pUR278 (Ruther et al., EMBO J. 2:1791 (1983)), in which the antibody coding sequence may be ligated individually into the vector in frame with the lac Z coding region so that a fusion protein is produced; pIN vectors (Inouye & Inouye, Nucleic Acids Res. 13:3101-3109 (1985); Van Heeke & Schuster, J. Biol. Chem. 24:5503-5509 (1989)); and the like. pGEX vectors may also be used to express foreign polypeptides as fusion proteins with glutathione S-transferase (GST). In general, such fusion proteins are soluble and can easily be purified from lysed cells by adsorption and binding to matrix glutathione-agarose beads followed by elution in the presence of free glutathione. The pGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The antibody coding sequence may be cloned individually into non-essential regions (for example the polyhedrin gene) of the virus and placed under control of an AcNPV promoter (for example the polyhedrin promoter).

In mammalian host cells, a number of viral-based expression systems may be utilized. In cases where an adenovirus is used as an expression vector, the antibody coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts. (e.g., see Logan & Shenk, Proc. Natl. Acad. Sci. USA 81:355-359 (1984)). Specific initiation signals may also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see Bittner et al., Methods in Enzymol. 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include but are not limited to CHO, VERY, BHK, Hela, COS, MDCK, 293, 3T3, W138, and in particular, breast cancer cell lines such as, for example, BT483, Hs578T, HTB2, BT20 and T47D, and normal mammary gland cell line such as, for example, CRL7030 and Hs578Bst.

For long-term, high-yield production of recombinant proteins, stable expression is preferred. For example, cell lines which stably express the antibody molecule may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compounds that interact directly or indirectly with the antibody molecule.

A number of selection systems may be used, including but not limited to the herpes simplex virus thymidine kinase (Wigler et al., Cell 11:223 (1977)), hypoxanthine-guanine phosphoribosyltransferase (Szybalska & Szybalski, Proc. Natl. Acad. Sci. USA 48:202 (1992)), and adenine phosphoribosyltransferase (Lowy et al., Cell 22:817 (1980)) genes can be employed in tk-, hgprt- or aprt- cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 Clinical Pharmacy 12:488-505; Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62:191-217 (1993); May, 1993, TIB TECH 11(5):155-215 (1993)); and hygro, which confers resistance to hygromycin (Santerre et al., Gene 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., J. Mol. Biol. 150:1 (1981), which are incorporated by reference herein in their entireties.

The expression levels of an antibody molecule can be increased by vector amplification (for a review, see Bebbington and Hentschel, The use of vectors based on gene amplification for the expression of cloned genes in mammalian cells in DNA cloning, Vol. 3. (Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse et al., Mol. Cell. Biol. 3:257 (1983)).

Vectors which use glutamine synthase (GS) or DHFR as the selectable markers can be amplified in the presence of the drugs methionine sulphoximine or methotrexate, respectively. An advantage of glutamine synthase based vectors are the availability of cell lines (e.g., the murine myeloma cell line, NS0) which are glutamine synthase negative. Glutamine synthase expression systems can also function in glutamine synthase expressing cells (e.g. Chinese Hamster Ovary (CHO) cells) by providing additional inhibitor to prevent the functioning of the endogenous gene. A glutamine synthase expression system and components thereof are detailed in PCT publications: WO87/04462; WO86/05807; WO89/01036; WO89/10404; and WO91/06657 which are incorporated in their entireties by reference herein. Additionally, glutamine synthase expression vectors that may be used according to the present invention are commercially available from suppliers, including, for example Lonza Biologics, Inc. (Portsmouth, N.H.). Expression and production of monoclonal antibodies using a GS expression system in murine myeloma cells is described in Bebbington et al., Bio/technology 10:169(1992) and in Biblia and Robinson *Biotechnol. Prog.* 11:1 (1995) which are incorporated in their entireties by reference herein.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature 322:52 (1986); Kohler, Proc. Natl. Acad. Sci. USA 77:2197 (1980)). The coding sequences for the heavy and light chains may comprise cDNA or genomic DNA.

Once an antibody molecule of the invention has been produced by an animal, chemically synthesized, or recombinantly expressed, it may be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. In addition, the antibodies of the present invention or fragments thereof can be fused to heterologous polypeptide sequences described herein or otherwise known in the art, to facilitate purification.

The present invention encompasses antibodies recombinantly fused or chemically conjugated (including both covalently and non-covalently conjugations) to a polypeptide (or portion thereof, preferably at least 10, 20, 30, 40, 50, 60, 70, 80, 90 or 100 amino acids of the polypeptide) of the present invention to generate fusion proteins. The fusion does not necessarily need to be direct, but may occur through linker sequences. The antibodies may be specific for antigens other than polypeptides (or portion thereof, preferably at least 10, 20, 30, 40, 50, 60, 70, 80, 90 or 100 amino acids of the polypeptide) of the present invention. For example, antibodies may be used to target the polypeptides of the present invention to particular cell types, either in vitro or in vivo, by fusing or conjugating the polypeptides of the present invention to antibodies specific for particular cell surface receptors. Antibodies fused or conjugated to the polypeptides of the present invention may also be used in in vitro immunoassays and purification methods using methods known in the art. See e.g., Harbor et al., supra, and PCT publication WO 93/21232; EP 439,095; Naramura et al., Immunol. Lett. 39:91-99 (1994); U.S. Pat. No. 5,474,981; Gillies et al., PNAS 89:1428-1432 (1992); Fell et al., J. Immunol. 146:2446-2452 (1991), which are incorporated by reference in their entireties.

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the constant region, hinge region, CH1 domain, CH2 domain, and CH3 domain or any combination of whole domains or portions thereof. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See, e.g., U.S. Pat. Nos. 5,336,603; 5,622,929; 5,359,046; 5,349,053; 5,447,851; 5,112,946; EP 307,434; EP 367,166; PCT publications WO 96/04388; WO 91/06570; Ashkenazi et al., Proc. Natl. Acad. Sci. USA 88:10535-10539 (1991); Zheng et al., J. Immunol. 154:5590-5600 (1995); and Vil et al., Proc. Natl. Acad. Sci. USA 89:11337-11341 (1992) (said references incorporated by reference in their entireties).

As discussed, supra, the polypeptides corresponding to a polypeptide, polypeptide fragment, or a variant of SEQ ID NO:Y may be fused or conjugated to the above antibody portions to increase the in vivo half life of the polypeptides or for use in immunoassays using methods known in the art. Further, the polypeptides corresponding to SEQ ID NO:Y may be fused or conjugated to the above antibody portions to facilitate purification. One reported example describes chimeric proteins consisting of the first two domains of the human CD4-polypeptide and various domains of the constant regions of the heavy or light chains of mammalian immunoglobulins. See EP 394,827; and Traunecker et al., Nature 331:84-86 (1988). The polypeptides of the present invention fused or conjugated to an antibody having disulfide-linked dimeric structures (due to the IgG) may also be more efficient in binding and neutralizing other molecules, than the monomeric secreted protein or protein fragment alone. See, for example, Fountoulakis et al., J. Biochem. 270:3958-3964 (1995). In many cases, the Fc part in a fusion protein is beneficial in therapy and diagnosis, and thus can result in, for example, improved pharmacokinetic properties. See, for example, EP A 232,262. Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL-5, have been fused with Fc portions for the purpose of high-throughput screening assays to identify antagonists of hIL-5. (See, Bennett et al., J. Molecular Recognition 8:52-58 (1995); Johanson et al., J. Biol. Chem. 270:9459-9471 (1995)).

Moreover, the antibodies or fragments thereof of the present invention can be fused to marker sequences, such as a peptide to facilitate purification. In preferred embodiments, the marker amino acid sequence is a hexa-histidine peptide, such as the tag provided in a pQE vector (QIAGEN, Inc., 9259 Eton Avenue, Chatsworth, Calif., 91311), among others, many of which are commercially available. As described in Gentz et al., Proc. Natl. Acad. Sci. USA 86:821-824 (1989), for instance, hexa-histidine provides for convenient purification of the fusion protein. Other peptide tags useful for purification include, but are not limited to, the "HA" tag, which corresponds to an epitope derived from the influenza hemagglutinin protein (Wilson et al., Cell 37:767 (1984)) and the "flag" tag.

The present invention further encompasses antibodies or fragments thereof conjugated to a diagnostic or therapeutic agent. The antibodies can be used diagnostically to, for example, monitor the development or progression of a tumor as part of a clinical testing procedure to, e.g., determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, radioactive materials, positron emitting metals using various positron emission tomographies, and nonradioactive paramagnetic metal ions. The detectable substance may be coupled or conjugated either directly to the antibody (or fragment thereof) or indirectly, through an intermediate (such as, for example, a linker known in the art) using techniques known in the art. See, for example, U.S. Pat. No. 4,741,900 for metal ions which can be conjugated to antibodies for use as diagnostics according to the present invention. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include 125I, 131I, 111In or 99Tc.

Further, an antibody or fragment thereof may be conjugated to a therapeutic moiety such as a cytotoxin, e.g., a cytostatic or cytocidal agent, a therapeutic agent or a radioactive metal ion, e.g., alpha-emitters such as, for example, 213BI. A cytotoxin or cytotoxic agent includes any agent that is detrimental to cells. Examples include paclitaxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the therapeutic agent or drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, a-interferon, β-interferon, nerve growth factor, platelet derived growth factor, tissue plasminogen activator, an apoptotic agent, e.g., TNF-alpha, TNF-beta, AIM I (See, International Publication No. WO 97/33899), AIM II (See, International Publication No. WO 97/34911), Fas Ligand (Takahashi et al., *Int. Immunol.*, 6:1567-1574 (1994)), VEGI (See, International Publication No. WO 99/23105), a thrombotic agent or an anti-angiogenic agent, e.g., angiostatin or endostatin; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors.

Antibodies may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Techniques for conjugating such therapeutic moiety to antibodies are well known. See, for example, Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev. 62:119-58 (1982).

Alternatively, an antibody can be conjugated to a second antibody to form an antibody heteroconjugate as described by Segal in U.S. Pat. No. 4,676,980, which is incorporated herein by reference in its entirety.

An antibody, with or without a therapeutic moiety conjugated to it, administered alone or in combination with cytotoxic factor(s) and/or cytokine(s) can be used as a therapeutic.

Immunophenotyping

The antibodies of the invention may be utilized for immunophenotyping of cell lines and biological samples. Translation products of the gene of the present invention may be useful as cell-specific markers, or more specifically as cellular markers that are differentially expressed at various stages of differentiation and/or maturation of particular cell types. Monoclonal antibodies directed against a specific epitope, or combination of epitopes, will allow for the screening of cellular populations expressing the marker. Various techniques can be utilized using monoclonal antibodies to screen for cellular populations expressing the marker(s), and include magnetic separation using antibody-coated magnetic beads, "panning" with antibody attached to a solid matrix (i.e., plate), and flow cytometry (See, e.g., U.S. Pat. No. 5,985,660; and Morrison et al., *Cell,* 96:737-49 (1999)).

These techniques allow for the screening of particular populations of cells, such as might be found with hematological malignancies (i.e. minimal residual disease (MRD) in acute leukemic patients) and "non-self" cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

Assays for Antibody Binding

The antibodies of the invention may be assayed for immunospecific binding by any method known in the art. The immunoassays which can be used include but are not limited to competitive and non-competitive assay systems using techniques such as western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, and protein A immunoassays, to name but a few. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Exemplary immunoassays are described briefly below (but are not intended by way of limitation).

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the antibody of interest to the cell lysate, incubating for a period of time (e.g., 1-4 hours) at 4° C., adding protein A and/or protein G sepharose beads to the cell lysate, incubating for about an hour or more at 4° C., washing the beads in lysis buffer and resuspending the beads in SDS/sample buffer. The ability of the antibody of interest to immunoprecipitate a particular antigen can be assessed by, e.g., western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al., eds., (1994), Current Protocols in Molecular Biology, Vol. 1, John Wiley & Sons, Inc., New York, section 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody (the antibody of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., 32P or 125I) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, (1994), Current Protocols in Molecular Biology, Vol. 1, John Wiley & Sons, Inc., New York, section 10.8.1.

ELISAs comprise preparing antigen, coating the well of a 96 well microtiter plate with the antigen, adding the antibody of interest conjugated to a detectable compound such as an enzymatic substrate (e.g., horseradish peroxidase or alkaline phosphatase) to the well and incubating for a period of time, and detecting the presence of the antigen. In ELISAs the antibody of interest does not have to be conjugated to a detectable compound; instead, a second antibody (which recognizes the antibody of interest) conjugated to a detectable compound may be added to the well. Further, instead of coating the well with the antigen, the antibody may be coated to the well. In this case, a second antibody conjugated to a detectable compound may be added following the addition of the antigen of interest to the coated well. One of skill in the art would be knowledgeable as to the parameters that can be modified to increase the signal detected as well as other variations of ELISAs known in the art. For further discussion regarding ELISAs see, e.g., Ausubel et al, eds, (1994), Current Protocols in Molecular Biology, Vol. 1, John Wiley & Sons, Inc., New York, section 11.2.1.

The binding affinity of an antibody to an antigen and the off-rate of an antibody-antigen interaction can be determined by competitive binding assays. One example of a competitive binding assay is a radioimmunoassay comprising the incubation of labeled antigen (e.g., 3H or 125I) with the antibody of interest in the presence of increasing amounts of unlabeled antigen, and the detection of the antibody bound to the labeled antigen. The affinity of the antibody of interest for a particular antigen and the binding off-rates can be determined from the data by scatchard plot analysis. Competition with a second antibody can also be determined using radioimmunoassays. In this case, the antigen is incubated with antibody of interest conjugated to a labeled compound (e.g., 3H or 125I) in the presence of increasing amounts of an unlabeled second antibody.

Antibodies of the invention may be characterized using immunocytochemistry methods on cells (e.g., mammalian cells, such as CHO cells) transfected with a vector enabling the expression of an antigen or with vector alone using techniques commonly known in the art. Antibodies that bind antigen transfected cells, but not vector-only transfected cells, are antigen specific.

Therapeutic Uses

Table 1D: In preferred embodiments, the present invention encompasses a method of treating a disease or disorder listed in the "Preferred Indications" column of Table 1D; comprising administering to a patient in which such treatment, prevention, or amelioration is desired a protein, nucleic acid, or antibody of the invention (or fragment or variant thereof) represented by Table 1A and Table 1D (in the same row as the disease or disorder to be treated is listed in the "Preferred Indications" column of Table 1D) in an amount effective to treat, prevent, or ameliorate the disease or disorder.

As indicated in Table 1D, the polynucleotides, polypeptides, agonists, or antagonists of the present invention (including antibodies) can be used in assays to test for one or more biological activities. If these polynucleotides and polypeptides do exhibit activity in a particular assay, it is likely that these molecules may be involved in the diseases associated with the biological activity. Thus, the polynucleotides or polypeptides, or agonists or antagonists thereof (including antibodies) could be used to treat the associated disease.

The present invention encompasses methods of preventing, treating, diagnosing, or ameliorating a disease or disorder. In preferred embodiments, the present invention encompasses a method of treating a disease or disorder listed in the "Preferred Indications" column of Table 1D; comprising administering to a patient in which such treatment, prevention, or amelioration is desired a protein, nucleic acid, or antibody of the invention (or fragment or variant thereof) in an amount effective to treat, prevent, diagnose, or ameliorate the disease or disorder. The first and second columns of Table 1D show the "Gene No." and "cDNA Clone ID No.", respectively, indicating certain nucleic acids and proteins (or antibodies against the same) of the invention (including polynucleotide, polypeptide, and antibody fragments or variants thereof) that may be used in preventing, treating, diagnosing, or ameliorating the disease(s) or disorder(s) indicated in the corresponding row in Column 3 of Table 1D.

In another embodiment, the present invention also encompasses methods of preventing, treating, diagnosing, or ameliorating a disease or disorder listed in the "Preferred Indications" column of Table 1D; comprising administering to a patient combinations of the proteins, nucleic acids, or antibodies of the invention (or fragments or variants thereof), sharing similar indications as shown in the corresponding rows in Column 3 of Table 1D.

The "Preferred Indication" column describes diseases, disorders, and/or conditions that may be treated, prevented, diagnosed, or ameliorated by a protein, nucleic acid, or antibody of the invention (or fragment or variant thereof).

The recitation of "Cancer" in the "Preferred Indication" column indicates that the corresponding nucleic acid and protein, or antibody against the same, of the invention (or fragment or variant thereof) may be used for example, to diagnose, treat, prevent, and/or ameliorate diseases and/or disorders relating to neoplastic diseases (e.g., leukemias, cancers, and/or as described below under "Hyperproliferative Disorders").

In specific embodiments, a protein, nucleic acid, or antibody of the invention (or fragment or variant thereof) having a "Cancer" recitation in the "Preferred Indication" column of Table 1D may be used for example, to diagnose, treat, prevent, and/or ameliorate a neoplasm located in a tissue selected from the group consisting of: colon, abdomen, bone, breast, digestive system, liver, pancreas, prostate, peritoneum, lung, blood (e.g., leukemia), endocrine glands (adrenal, parathyroid, pituitary, testicles, ovary, thymus, thyroid), uterus, eye, head and neck, nervous (central and peripheral), lymphatic system, pelvic, skin, soft tissue, spleen, thoracic, and urogenital.

In specific embodiments, a protein, nucleic acid, or antibody of the invention (or fragment or variant thereof) having a "Cancer" recitation in the "Preferred Indication" column of Table 1D, may be used for example, to diagnose, treat, prevent, and/or ameliorate a pre-neoplastic condition, selected from the group consisting of: hyperplasia (e.g., endometrial hyperplasia and/or as described in the section entitled "Hyperproliferative Disorders"), metaplasia (e.g., connective tissue metaplasia, atypical metaplasia, and/or as described in the section entitled "Hyperproliferative Disorders"), and/or dysplasia (e.g., cervical dysplasia, and bronchopulmonary dysplasia).

In another specific embodiment, a protein, nucleic acid, or antibody of the invention (or fragment or variant thereof) having a "Cancer" recitation in the "Preferred Indication" column of Table 1D, may be used for example, to diagnose, treat, prevent, and/or ameliorate a benign dysproliferative disorder selected from the group consisting of: benign tumors, fibrocystic conditions, tissue hypertrophy, and/or as described in the section entitled "Hyperproliferative Disorders".

The recitation of "Immune/Hematopoietic" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), blood disorders (e.g., as described below under "Immune Activity" "Cardiovascular Disorders" and/or "Blood-Related Disorders"), and infections (e.g., as described below under "Infectious Disease").

In specific embodiments, a protein, nucleic acid, or antibody of the invention (or fragment or variant thereof) having the "Immune/Hematopoietic" recitation in the "Preferred Indication" column of Table 1D, may be used for example, to diagnose, treat, prevent, and/or ameliorate a disease or disorder selected from the group consisting of: anemia, pancytopenia, leukopenia, thrombocytopenia, leukemias, Hodgkin's disease, non-Hodgkin's lymphoma, acute lymphocytic anemia (ALL), plasmacytomas, multiple myeloma, Burkitt's lymphoma, arthritis, asthma, AIDS, autoimmune disease, rheumatoid arthritis, granulomatous disease, immune deficiency, inflammatory bowel disease, sepsis, neutropenia, neutrophilia, psoriasis, immune reactions to transplanted organs and tissues, systemic lupus erythematosis, hemophilia, hypercoagulation, diabetes mellitus, endocarditis, meningitis, Lyme Disease, and allergies.

The recitation of "Reproductive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the reproductive system (e.g., as described below under "Reproductive System Disorders").

In specific embodiments, a protein, nucleic acid, or antibody of the invention (or fragment or variant thereof) having a "Reproductive" recitation in the "Preferred Indication" column of Table 1D, may be used for example, to diagnose, treat, prevent, and/or ameliorate a disease or disorder selected from the group consisting of: cryptorchism, prostatitis, inguinal hernia, varicocele, leydig cell tumors, verrucous carcinoma, prostatitis, malacoplakia, Peyronie's disease, penile carcinoma, squamous cell hyperplasia, dysmenorrhea, ovarian adenocarcinoma, Turner's syndrome, mucopurulent cervicitis, Sertoli-leydig tumors, ovarian cancer, uterine cancer, pelvic inflammatory disease, testicular cancer, prostate cancer, Klinefelter's syndrome, Young's syndrome, premature ejaculation, diabetes mellitus, cystic fibrosis, Kartagener's syndrome, testicular atrophy, testicular feminization, anorchia, ectopic testis, epididymitis, orchitis, gonorrhea, syphilis, testicular torsion, vasitis nodosa, germ cell tumors, stromal tumors, dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding, cervicitis, chronic cervicitis, mucopurulent cervicitis, cervical dysplasia, cervical polyps, Nabothian cysts, cervical erosion, cervical incompetence, cervical neoplasms, pseudohermaphroditism, and premenstrual syndrome.

The recitation of "Musculoskeletal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the immune system (e.g., as described below under "Immune Activity").

In specific embodiments, a protein, nucleic acid, or antibody of the invention (or fragment or variant thereof) having a "Musculoskeletal" recitation in the "Preferred Indication" column of Table 1D, may be used for example, to diagnose, treat, prevent, and/or ameliorate a disease or disorder selected from the group consisting of: bone cancers (e.g., osteochondromas, benign chondromas, chondroblastoma, chondromyxoid fibromas, osteoid osteomas, giant cell tumors, multiple myeloma, osteosarcomas), Paget's Disease, rheumatoid arthritis, systemic lupus erythematosus, osteomyelitis, Lyme Disease, gout, bursitis, tendonitis, osteoporosis, osteoarthritis, muscular dystrophy, mitochondrial myopathy, cachexia, and multiple sclerosis.

The recitation of "Cardiovascular" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), and disorders of the cardiovascular system (e.g., as described below under "Cardiovascular Disorders").

In specific embodiments, a protein, nucleic acid, or antibody of the invention (or fragment or variant thereof) having a "Cardiovascular" recitation in the "Preferred Indication" column of Table 1D, may be used for example, to diagnose, treat, prevent, and/or ameliorate a disease or disorder selected from the group consisting of: myxomas, fibromas, rhabdomyomas, cardiovascular abnormalities (e.g., congenital heart defects, cerebral arteriovenous malformations, septal defects), heart disease (e.g., heart failure, congestive heart disease, arrhythmia, tachycardia, fibrillation, pericardial Disease, endocarditis), cardiac arrest, heart valve disease (e.g., stenosis, regurgitation, prolapse), vascular disease (e.g., hypertension, coronary artery disease, angina, aneurysm, arteriosclerosis, peripheral vascular disease), hyponatremia, hypematremia, hypokalemia, and hyperkalemia.

The recitation of "Mixed Fetal" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders").

In specific embodiments, a protein, nucleic acid, or antibody of the invention (or fragment or variant thereof) having a "Mixed Fetal" recitation in the "Preferred Indication" column of Table 1D, may be used for example, to diagnose, treat, prevent, and/or ameliorate a disease or disorder selected from the group consisting of: spina bifida, hydranencephaly, neurofibromatosis, fetal alcohol syndrome, diabetes mellitus, PKU, Down's syndrome, Patau syndrome, Edwards syndrome, Turner syndrome, Apert syndrome, Carpenter syndrome, Conradi syndrome, Crouzon syndrome, cutis laxa, Cornelia de Lange syndrome, Ellis-van Creveld syndrome, Holt-Oram syndrome, Kartagener syndrome, Meckel-Gruber syndrome, Noonan syndrome, Pallister-Hall syndrome, Rubinstein-Taybi syndrome, Scimitar syndrome, Smith-Lemli-Opitz syndrome, thromocytopenia-absent radius (TAR) syndrome, Treacher Collins syndrome, Williams syndrome, Hirschsprung's disease, Meckel's diverticulum, polycystic kidney disease, Turner's syndrome, and gonadal dysgenesis, Klippel-Feil syndrome, Ostogenesis imperfecta, muscular dystrophy, Tay-Sachs disease, Wilm's tumor, neuroblastoma, and retinoblastoma.

The recitation of "Excretory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and renal disorders (e.g., as described below under "Renal Disorders").

In specific embodiments, a protein, nucleic acid, or antibody of the invention (or fragment or variant thereof) having a "Excretory" recitation in the "Preferred Indication" column of Table 1D, may be used for example, to diagnose, treat, prevent, and/or ameliorate a disease or disorder selected from the group consisting of: bladder cancer, prostate cancer, benign prostatic hyperplasia, bladder disorders (e.g., urinary incontinence, urinary retention, urinary obstruction, urinary tract Infections, interstitial cystitis, prostatitis, neurogenic bladder, hematuria), renal disorders (e.g., hydronephrosis, proteinuria, renal failure, pyelonephritis, urolithiasis, reflux nephropathy, and unilateral obstructive uropathy).

The recitation of "Neural/Sensory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the nervous system (e.g., as described below under "Neural Activity and Neurological Diseases").

In specific embodiments, a protein, nucleic acid, or antibody of the invention (or fragment or variant thereof) having a "Neural/Sensory" recitation in the "Preferred Indication" column of Table 1D, may be used for example, to diagnose, treat, prevent, and/or ameliorate a disease or disorder selected from the group consisting of: brain cancer (e.g., brain stem glioma, brain tumors, central nervous system (Primary) lymphoma, central nervous system lymphoma, cerebellar astrocytoma, and cerebral astrocytoma, neurodegenerative disorders (e.g., Alzheimer's Disease, Creutzfeldt-Jakob Disease, Parkinson's Disease, and Idiopathic Presenile Dementia), encephalomyelitis, cerebral malaria, meningitis, metabolic brain diseases (e.g., phenylketonuria and pyruvate carboxylase deficiency), cerebellar ataxia, ataxia telangiectasia, and AIDS Dementia Complex, schizophrenia, attention deficit disorder, hyperactive attention deficit disorder, autism, and obsessive compulsive disorders.

The recitation of "Respiratory" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders").

In specific embodiments, a protein, nucleic acid, or antibody of the invention (or fragment or variant thereof) having a "Respiratory" recitation in the "Preferred Indication" column of Table 1D, may be used for example, to diagnose, treat, prevent, and/or ameliorate a disease or disorder selected from the group consisting of: cancers of the respiratory system such as larynx cancer, pharynx cancer, trachea cancer, epiglottis cancer, lung cancer, squamous cell carcinomas, small cell (oat cell) carcinomas, large cell carcinomas, and adenocarcinomas. Allergic reactions, cystic fibrosis, sarcoidosis, histiocytosis X, infiltrative lung diseases (e.g., pulmonary fibrosis and lymphoid interstitial pneumonia), obstructive airway diseases (e.g., asthma, emphysema, chronic or acute bronchitis), occupational lung diseases (e.g., silicosis and asbestosis), pneumonia, and pleurisy.

The recitation of "Endocrine" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the respiratory system (e.g., as described below under "Respiratory Disorders"), renal disorders (e.g., as described below under "Renal Disorders"), and disorders of the endocrine system (e.g., as described below under "Endocrine Disorders".

In specific embodiments, a protein, nucleic acid, or antibody of the invention (or fragment or variant thereof) having an "Endocrine" recitation in the "Preferred Indication" column of Table 1D, may be used for example, to diagnose, treat, prevent, and/or ameliorate a disease or disorder selected from the group consisting of: cancers of endocrine tissues and organs (e.g., cancers of the hypothalamus, pituitary gland, thyroid gland, parathyroid glands, pancreas, adrenal glands, ovaries, and testes), diabetes (e.g., diabetes insipidus, type I and type II diabetes mellitus), obesity, disorders related to pituitary glands (e.g., hyperpituitarism, hypopituitarism, and pituitary dwarfism), hypothyroidism, hyperthyroidism, goiter, reproductive disorders (e.g. male and female infertility), disorders related to adrenal glands (e.g., Addison's Disease, corticosteroid deficiency, and Cushing's Syndrome), kidney cancer (e.g., hypernephroma, transitional cell cancer, and Wilm's tumor), diabetic nephropathy, interstitial nephritis, polycystic kidney disease, glomerulonephritis (e.g., IgM mesangial proliferative glomerulonephritis and glomerulonephritis caused by autoimmune disorders; such as Goodpasture's syndrome), and nephrocalcinosis.

The recitation of "Digestive" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders") and diseases or disorders of the gastrointestinal system (e.g., as described below under "Gastrointestinal Disorders".

In specific embodiments, a protein, nucleic acid, or antibody of the invention (or fragment or variant thereof) having a "Digestive" recitation in the "Preferred Indication" column of Table 1D, may be used for example, to diagnose, treat, prevent, and/or ameliorate a disease or disorder selected from the group consisting of: ulcerative colitis, appendicitis, Crohn's disease, hepatitis, hepatic encephalopathy, portal hypertension, cholelithiasis, cancer of the digestive system (e.g., biliary tract cancer, stomach cancer, colon cancer, gastric cancer, pancreatic cancer, cancer of the bile duct, tumors of the colon (e.g., polyps or cancers), and cirrhosis), pancreatitis, ulcerative disease, pyloric stenosis, gastroenteritis, gastritis, gastric atropy, benign tumors of the duodenum, distension, irritable bowel syndrome, malabsorption, congenital disorders of the small intestine, bacterial and parasitic infection, megacolon, Hirschsprung's disease, aganglionic megacolon, acquired megacolon, colitis, anorectal disorders (e.g., anal fistulas, hemorrhoids), congenital disorders of the liver (e.g., Wilson's disease, hemochromatosis, cystic fibrosis, biliary atresia, and alpha1-antitrypsin deficiency), portal hypertension, cholelithiasis, and jaundice.

The recitation of "Connective/Epithelial" in the "Preferred Indication" column indicates that the corresponding nucleic acid and protein, or antibody against the same, of the invention (or fragment or variant thereof), may be used for example, to diagnose, treat, prevent, and/or ameliorate diseases and/or disorders relating to neoplastic diseases (e.g., as described below under "Hyperproliferative Disorders"), cellular and genetic abnormalities (e.g., as described below under "Diseases at the Cellular Level"), angiogenesis (e.g., as described below under "Anti-Angiogenesis Activity"), and or to promote or inhibit regeneration (e.g., as described below under "Regeneration"), and wound healing (e.g., as described below under "Wound Healing and Epithelial Cell Proliferation").

In specific embodiments, a protein, nucleic acid, or antibody of the invention (or fragment or variant thereof) having a "Connective/Epithelial" recitation in the "Preferred Indication" column of Table 1D, may be used for example, to diagnose, treat, prevent, and/or ameliorate a disease or disorder selected from the group consisting of: connective tissue metaplasia, mixed connective tissue disease, focal epithelial hyperplasia, epithelial metaplasia, mucoepithelial dysplasia, graft v. host disease, polymyositis, cystic hyperplasia, cerebral dysplasia, tissue hypertrophy, Alzheimer's disease, lymphoproliferative disorder, Waldenstron's macroglobulinemia, Crohn's disease, pernicious anemia, idiopathic Addison's disease, glomerulonephritis, bullous pemphigoid, Sjogren's syndrome, diabetes mellitus, cystic fibrosis, osteoblastoma, osteoclastoma, osteosarcoma, chondrosarcoma, osteoporosis, osteocarthritis, periodontal disease, wound healing, relapsing polychondritis, vasculitis, polyarteritis nodosa, Wegener's granulomatosis, cellulitis, rheumatoid arthritis, psoriatic arthritis, discoid lupus erythematosus, systemic lupus erythematosus, scleroderma, CREST syndrome, Sjogren's syndrome, polymyositis, dermatomyositis, mixed connective tissue disease, relapsing polychondritis, vasculitis, Henoch-Schonlein syndrome, erythema nodosum, polyarteritis nodosa, temporal (giant cell) arteritis, Takayasu's arteritis, Wegener's granulomatosis, Reiter's syndrome, Behcet's syndrome, ankylosing spondylitis, cellulitis, keloids, Ehler Danlos syndrome, Marfan syndrome, pseudoxantoma elasticum, osteogenese imperfecta, chondrodysplasias, epidermolysis bullosa, Alport syndrome, and cutis laxa.

Table 1E also provides information regarding biological activities and preferred therapeutic uses (i.e. see, "Preferred Indications" column) for polynucleotides and polypeptides of the invention (including antibodies, agonists, and/or antagonists thereof). Table 1E also provides information regarding assays which may be used to test polynucleotides and polypeptides of the invention (including antibodies, agonists, and/or antagonists thereof) for the corresponding biological activities. The first column ("Gene No.") provides the gene number in the application for each clone identifier. The second column ("cDNA ATCC™ Deposit No:Z") provides the unique clone identifier for each clone as previously described and indicated in Tables 1A, 1B, 1C, and 1D. The third column ("AA SEQ ID NO:Y") indicates the Sequence Listing SEQ ID Number for polypeptide sequences encoded by the corresponding cDNA clones (also as indicated in Tables 1A, 1B, and 2). The fourth column ("Biological Activity") indicates a biological activity corresponding to the indicated polypeptides (or polynucleotides encoding said polypeptides). The fifth column ("Exemplary Activity Assay") further describes the corresponding biological activity and also provides information pertaining to the various types of assays which may be performed to test, demonstrate, or quantify the corresponding biological activity. The sixth column ("Preferred Indications") describes particular embodiments of the invention as well as indications (e.g. pathologies, diseases, disorders, abnormalities, etc.) for which polynucleotides and polypeptides of the invention (including antibodies, agonists, and/or antagonists thereof) may be used in detecting, diagnosing, preventing, and/or treating.

The present invention is further directed to antibody-based therapies which involve administering antibodies of the invention to an animal, preferably a mammal, and most preferably a human, patient for treating one or more of the disclosed diseases, disorders, or conditions. Therapeutic compounds of the invention include, but are not limited to, antibodies of the invention (including fragments, analogs and derivatives thereof as described herein) and nucleic acids encoding antibodies of the invention (including fragments, analogs and derivatives thereof and anti-idiotypic antibodies as described herein). The antibodies of the invention can be used to treat, inhibit or prevent diseases, disorders or conditions associated with aberrant expression and/or activity of a polypeptide of the invention, including, but not limited to, any one or more of the diseases, disorders, or conditions described herein. The treatment and/or prevention of diseases, disorders, or conditions associated with aberrant expression and/or activity of a polypeptide of the invention includes, but is not limited to, alleviating symptoms associated with those diseases, disorders or conditions. Antibodies of the invention may be provided in pharmaceutically acceptable compositions as known in the art or as described herein.

In a specific and preferred embodiment, the present invention is directed to antibody-based therapies which involve administering antibodies of the invention to an animal, preferably a mammal, and most preferably a human, patient for treating one or more diseases, disorders, or conditions, including but not limited to: neural disorders, immune system disorders, muscular disorders, reproductive disorders, gastrointestinal disorders, pulmonary disorders, cardiovascular disorders, renal disorders, proliferative disorders, and/or cancerous diseases and conditions, and/or as described elsewhere herein. Therapeutic compounds of the invention include, but are not limited to, antibodies of the invention (e.g., antibodies directed to the full length protein expressed on the cell surface of a mammalian cell; antibodies directed to an epitope of a polypeptide of the invention (such as, for example, a predicted linear epitope shown in column 7 of Table 1B.1; or a conformational epitope, including fragments, analogs and derivatives thereof as described herein) and nucleic acids encoding antibodies of the invention (including fragments, analogs and derivatives thereof and anti-idiotypic antibodies as described herein). The antibodies of the invention can be used to treat, inhibit or prevent diseases, disorders or conditions associated with aberrant expression and/or activity of a polypeptide of the invention, including, but not limited to, any one or more of the diseases, disorders, or conditions described herein. The treatment and/or prevention of diseases, disorders, or conditions associated with aberrant expression and/or activity of a polypeptide of the invention includes, but is not limited to, alleviating symptoms associated with those diseases, disorders or conditions. Antibodies of the invention may be provided in pharmaceutically acceptable compositions as known in the art or as described herein.

A summary of the ways in which the antibodies of the present invention may be used therapeutically includes binding polynucleotides or polypeptides of the present invention locally or systemically in the body or by direct cytotoxicity of the antibody, e.g. as mediated by complement (CDC) or by effector cells (ADCC). Some of these approaches are described in more detail below. Armed with the teachings provided herein, one of ordinary skill in the art will know how to use the antibodies of the present invention for diagnostic, monitoring or therapeutic purposes without undue experimentation.

The antibodies of this invention may be advantageously utilized in combination with other monoclonal or chimeric antibodies, or with lymphokines or hematopoietic growth factors (such as, e.g., IL-2, IL-3 and IL-7), for example, which serve to increase the number or activity of effector cells which interact with the antibodies.

The antibodies of the invention may be administered alone or in combination with other types of treatments (e.g., radiation therapy, chemotherapy, hormonal therapy, immunotherapy and anti-tumor agents). Generally, administration of products of a species origin or species reactivity (in the case of antibodies) that is the same species as that of the patient is preferred. Thus, in a preferred embodiment, human antibodies, fragments derivatives, analogs, or nucleic acids, are administered to a human patient for therapy or prophylaxis.

It is preferred to use high affinity and/or potent in vivo inhibiting and/or neutralizing antibodies against polypeptides or polynucleotides of the present invention, fragments or regions thereof, for both immunoassays directed to and therapy of disorders related to polynucleotides or polypeptides, including fragments thereof, of the present invention. Such antibodies, fragments, or regions, will preferably have an affinity for polynucleotides or polypeptides of the invention, including fragments thereof. Preferred binding affinities include those with a dissociation constant or Kd less than $5\times10^{-2}$ M, $10^{-2}$ M, $5\times10^{-3}$ M, $10^{-3}$ M, $5\times10^{-4}$ M, $10^{-4}$ M, $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10^{-15}$ M, and $10^{-15}$ M.

Gene Therapy

In a specific embodiment, nucleic acids comprising sequences encoding antibodies or functional derivatives thereof, are administered to treat, inhibit or prevent a disease or disorder associated with aberrant expression and/or activity of a polypeptide of the invention, by way of gene therapy. Gene therapy refers to therapy performed by the administration to a subject of an expressed or expressible nucleic acid. In this embodiment of the invention, the nucleic acids produce their encoded protein that mediates a therapeutic effect.

Any of the methods for gene therapy available in the art can be used according to the present invention. Exemplary methods are described below.

For general reviews of the methods of gene therapy, see Goldspiel et al., Clinical Pharmacy 12:488-505 (1993); Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62:191-217 (1993); May, TIBTECH 11(5):155-215 (1993). Methods commonly known in the art of recombinant DNA technology which can be used are described in Ausubel et al. (eds.), Current Protocols in Molecular Biology, John Wiley & Sons, NY (1993); and Kriegler, Gene Transfer and Expression, A Laboratory Manual, Stockton Press, NY (1990).

In a preferred embodiment, the compound comprises nucleic acid sequences encoding an antibody, said nucleic acid sequences being part of expression vectors that express the antibody or fragments or chimeric proteins or heavy or light chains thereof in a suitable host. In particular, such nucleic acid sequences have promoters operably linked to the antibody coding region, said promoter being inducible or constitutive, and, optionally, tissue-specific. In another particular embodiment, nucleic acid molecules are used in which the antibody coding sequences and any other desired sequences are flanked by regions that promote homologous recombination at a desired site in the genome, thus providing for intrachromosomal expression of the antibody encoding nucleic acids (Koller and Smithies, Proc. Natl. Acad. Sci. USA 86:8932-8935 (1989); Zijlstra et al., Nature 342:435-438 (1989). In specific embodiments, the expressed antibody molecule is a single chain antibody; alternatively, the nucleic acid sequences include sequences encoding both the heavy and light chains, or fragments thereof, of the antibody.

Delivery of the nucleic acids into a patient may be either direct, in which case the patient is directly exposed to the nucleic acid or nucleic acid-carrying vectors, or indirect, in which case, cells are first transformed with the nucleic acids in vitro, then transplanted into the patient. These two approaches are known, respectively, as in vivo or ex vivo gene therapy.

In a specific embodiment, the nucleic acid sequences are directly administered in vivo, where it is expressed to produce the encoded product. This can be accomplished by any of numerous methods known in the art, e.g., by constructing them as part of an appropriate nucleic acid expression vector and administering it so that they become intracellular, e.g., by infection using defective or attenuated retrovirals or other viral vectors (see U.S. Pat. No. 4,980,286), or by direct injection of naked DNA, or by use of microparticle bombardment (e.g., a gene gun; Biolistic, Dupont), or coating with lipids or cell-surface receptors or transfecting agents, encapsulation in liposomes, microparticles, or microcapsules, or by administering them in linkage to a peptide which is known to enter the nucleus, by administering it in linkage to a ligand subject to receptor-mediated endocytosis (see, e.g., Wu and Wu, J. Biol. Chem. 262:4429-4432 (1987)) (which can be used to target cell types specifically expressing the receptors), etc. In another embodiment, nucleic acid-ligand complexes can be formed in which the ligand comprises a fusogenic viral peptide to disrupt endosomes, allowing the nucleic acid to avoid lysosomal degradation. In yet another embodiment, the nucleic acid can be targeted in vivo for cell specific uptake and expression, by targeting a specific receptor (see, e.g., PCT Publications WO 92/06180; WO 92/22635; WO92/20316; WO93/14188, WO 93/20221). Alternatively, the nucleic acid can be introduced intracellularly and incorporated within host cell DNA for expression, by homologous recombination (Koller and Smithies, Proc. Natl. Acad. Sci. USA 86:8932-8935 (1989); Zijlstra et al., Nature 342:435-438 (1989)).

In a specific embodiment, viral vectors that contains nucleic acid sequences encoding an antibody of the invention are used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding the antibody to be used in gene therapy are cloned into one or more vectors, which facilitates delivery of the gene into a patient. More detail about retroviral vectors can be found in Boesen et al., Biotherapy 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993).

Adenoviruses are other viral vectors that can be used in gene therapy. Adenoviruses are especially attractive vehicles for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499-503 (1993) present a review of adenovirus-based gene therapy. Bout et al., Human Gene Therapy 5:3-10 (1994) demonstrated the use of adenovirus vectors to transfer genes to the respiratory epithelia of rhesus monkeys. Other instances of the use of adenoviruses in gene therapy can be found in Rosenfeld et al., Science 252:431-434 (1991); Rosenfeld et al., Cell 68:143-155 (1992); Mastrangeli et al., J. Clin. Invest. 91:225-234 (1993); PCT Publication WO94/12649; and Wang, et al., Gene Therapy 2:775-783 (1995). In a preferred embodiment, adenovirus vectors are used.

Adeno-associated virus (AAV) has also been proposed for use in, gene therapy (Walsh et al., Proc. Soc. Exp. Biol. Med. 204:289-300 (1993); U.S. Pat. No. 5,436,146).

Another approach to gene therapy involves transferring a gene to cells in tissue culture by such methods as electroporation, lipofection, calcium phosphate mediated transfection, or viral infection. Usually, the method of transfer includes the transfer of a selectable marker to the cells. The cells are then placed under selection to isolate those cells that have taken up and are expressing the transferred gene. Those cells are then delivered to a patient.

In this embodiment, the nucleic acid is introduced into a cell prior to administration in vivo of the resulting recombinant cell. Such introduction can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see, e.g., Loeffler and Behr, Meth. Enzymol. 217:599-618 (1993); Cohen et al., Meth. Enzymol. 217:618-644 (1993); Cline, Pharmac. Ther. 29:69-92m (1985) and may be used in accordance with the present invention, provided that the necessary developmental and physiological functions of the recipient cells are not disrupted. The technique should provide for the stable transfer of the nucleic acid to the cell, so that the nucleic acid is expressible by the cell and preferably heritable and expressible by its cell progeny.

The resulting recombinant cells can be delivered to a patient by various methods known in the art. Recombinant blood cells (e.g., hematopoietic stem or progenitor cells) are preferably administered intravenously. The amount of cells envisioned for use depends on the desired effect, patient state, etc., and can be determined by one skilled in the art.

Cells into which a nucleic acid can be introduced for purposes of gene therapy encompass any desired, available cell type, and include but are not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., as obtained from bone marrow, umbilical cord blood, peripheral blood, fetal liver, etc.

In a preferred embodiment, the cell used for gene therapy is autologous to the patient.

In an embodiment in which recombinant cells are used in gene therapy, nucleic acid sequences encoding an antibody are introduced into the cells such that they are expressible by the cells or their progeny, and the recombinant cells are then administered in vivo for therapeutic effect. In a specific embodiment, stem or progenitor cells are used. Any stem and/or progenitor cells which can be isolated and maintained in vitro can potentially be used in accordance with this embodiment of the present invention (see e.g. PCT Publication WO 94/08598; Stemple and Anderson, Cell 71:973-985 (1992); Rheinwald, Meth. Cell Bio. 21A:229 (1980); and Pittelkow and Scott, Mayo Clinic Proc. 61:771 (1986)).

In a specific embodiment, the nucleic acid to be introduced for purposes of gene therapy comprises an inducible promoter operably linked to the coding region, such that expression of the nucleic acid is controllable by the presence or absence of an appropriate inducer of transcription.

Demonstration of Therapeutic or Prophylactic Activity

The compounds or pharmaceutical compositions of the invention are preferably tested in vitro, and then in vivo for the desired therapeutic or prophylactic activity, prior to use in humans. For example, in vitro assays to demonstrate the therapeutic or prophylactic utility of a compound or pharmaceutical composition include, the effect of a compound on a cell line or a patient tissue sample. The effect of the compound or composition on the cell line and/or tissue sample can be determined utilizing techniques known to those of skill in the art including, but not limited to, rosette formation assays and cell lysis assays. In accordance with the invention, in vitro assays which can be used to determine whether administration of a specific compound is indicated, include in vitro cell culture assays in which a patient tissue sample is grown in culture, and exposed to or otherwise administered a compound, and the effect of such compound upon the tissue sample is observed.

Therapeutic/Prophylactic Administration and Composition

The invention provides methods of treatment, inhibition and prophylaxis by administration to a subject of an effective amount of a compound or pharmaceutical composition of the invention, preferably a polypeptide or antibody of the invention. In a preferred embodiment, the compound is substantially purified (e.g., substantially free from substances that limit its effect or produce undesired side-effects). The subject is preferably an animal, including but not limited to animals such as cows, pigs, horses, chickens, cats, dogs, etc., and is preferably a mammal, and most preferably human.

Formulations and methods of administration that can be employed when the compound comprises a nucleic acid or an immunoglobulin are described above; additional appropriate formulations and routes of administration can be selected from among those described herein below.

Various delivery systems are known and can be used to administer a compound of the invention, e.g., encapsulation in liposomes, microparticles, microcapsules, recombinant cells capable of expressing the compound, receptor-mediated endocytosis (see, e.g., Wu and Wu, J. Biol. Chem. 262:4429-4432 (1987)), construction of a nucleic acid as part of a retroviral or other vector, etc. Methods of introduction include but are not limited to intradermal, intramuscular, intraperitoneal, intravenous, subcutaneous, intranasal, epidural, and oral routes. The compounds or compositions may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, it may be desirable to introduce the pharmaceutical compounds or compositions of the invention into the central nervous system by any suitable route, including intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it may be desirable to administer the pharmaceutical compounds or compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antibody, of the invention, care must be taken to use materials to which the protein does not absorb.

In another embodiment, the compound or composition can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.)

In yet another embodiment, the compound or composition can be delivered in a controlled release system. In one embodiment, a pump may be used (see Langer, supra; Sefton, CRC Crit. Ref. Biomed. Eng. 14:201 (1987); Buchwald et al., Surgery 88:507 (1980); Saudek et al., N. Engl. J. Med. 321:574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:61 (1983); see also Levy et al., Science 228:190 (1985); During et al., Ann. Neurol. 25:351 (1989); Howard et al., J. Neurosurg. 71:105 (1989)). In yet another embodiment, a controlled release system can be placed in proximity of the therapeutic target, e.g., the brain, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

In a specific embodiment where the compound of the invention is a nucleic acid encoding a protein, the nucleic acid can be administered in vivo to promote expression of its encoded protein, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see e.g., Joliot et al., Proc. Natl. Acad. Sci. USA 88:1864-4868 (1991)), etc. Alternatively, a nucleic acid can be introduced intracellularly and incorporated within host cell DNA for expression, by homologous recombination.

The present invention also provides pharmaceutical compositions. Such compositions comprise a therapeutically effective amount of a compound, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders; sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the compound, preferably in purified form, together with a suitable amount of carrier so as to provide the form for proper administration to the patient. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The compounds of the invention can be formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The amount of the compound of the invention which will be effective in the treatment, inhibition and prevention of a disease or disorder associated with aberrant expression and/or activity of a polypeptide of the invention can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses may be extrapolated from dose-response curves derived from in vitro or animal model test systems.

For antibodies, the dosage administered to a patient is typically 0.1 mg/kg to 100 mg/kg of the patient's body weight. Preferably, the dosage administered to a patient is between 0.1 mg/kg and 20 mg/kg of the patient's body weight, more preferably 1 mg/kg to 10 mg/kg of the patient's body weight. Generally, human antibodies have a longer half-life within the human body than antibodies from other species due to the immune response to the foreign polypeptides. Thus, lower dosages of human antibodies and less frequent administration is often possible. Further, the dosage and frequency of administration of antibodies of the invention may be reduced by enhancing uptake and tissue penetration (e.g., into the brain) of the antibodies by modifications such as, for example, lipidation.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

Diagnosis and Imaging

Labeled antibodies, and derivatives and analogs thereof, which specifically bind to a polypeptide of interest can be used for diagnostic purposes to detect, diagnose, or monitor diseases, disorders, and/or conditions associated with the aberrant expression and/or activity of a polypeptide of the invention. The invention provides for the detection of aberrant expression of a polypeptide of interest, comprising (a) assaying the expression of the polypeptide of interest in cells or body fluid of an individual using one or more antibodies specific to the polypeptide interest and (b) comparing the level of gene expression with a standard gene expression level, whereby an increase or decrease in the assayed polypeptide gene expression level compared to the standard expression level is indicative of aberrant expression.

The invention provides a diagnostic assay for diagnosing a disorder, comprising (a) assaying the expression of the polypeptide of interest in cells or body fluid of an individual using one or more antibodies specific to the polypeptide interest and (b) comparing the level of gene expression with a standard gene expression level, whereby an increase or decrease in the assayed polypeptide gene expression level compared to the standard expression level is indicative of a particular disorder. With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Antibodies of the invention can be used to assay protein levels in a biological sample using classical immunohistological methods known to those of skill in the art (e.g., see Jalkanen et al., J. Cell. Biol. 101:976-985 (1985); Jalkanen et al., J. Cell. Biol. 105:3087-3096 (1987)). Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase; radioisotopes, such as iodine (125I, 121I), carbon (14C), sulfur (35S), tritium (3H), indium (112In), and technetium (99Tc); luminescent labels, such as luminol; and fluorescent labels, such as fluorescein and rhodamine, and biotin.

One facet of the invention is the detection and diagnosis of a disease or disorder associated with aberrant expression of a polypeptide of interest in an animal, preferably a mammal and most preferably a human. In one embodiment, diagnosis comprises: a) administering (for example, parenterally, subcutaneously, or intraperitoneally) to a subject an effective amount of a labeled molecule which specifically binds to the polypeptide of interest; b) waiting for a time interval following the administering for permitting the labeled molecule to preferentially concentrate at sites in the subject where the polypeptide is expressed (and for unbound labeled molecule to be cleared to background level); c) determining background level; and d) detecting the labeled molecule in the subject, such that detection of labeled molecule above the background level indicates that the subject has a particular disease or disorder associated with aberrant expression of the polypeptide of interest. Background level can be determined by various methods including, comparing the amount of labeled molecule detected to a standard value previously determined for a particular system.

It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99mTc. The labeled antibody or antibody fragment will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982)).

Depending on several variables, including the type of label used and the mode of administration, the time interval following the administration for permitting the labeled molecule to preferentially concentrate at sites in the subject and for unbound labeled molecule to be cleared to background level is 6 to 48 hours or 6 to 24 hours or 6 to 12 hours. In another embodiment the time interval following administration is 5 to 20 days or 5 to 10 days.

In an embodiment, monitoring of the disease or disorder is carried out by repeating the method for diagnosing the disease or disease, for example, one month after initial diagnosis, six months after initial diagnosis, one year after initial diagnosis, etc.

Presence of the labeled molecule can be detected in the patient using methods known in the art for in vivo scanning. These methods depend upon the type of label used. Skilled artisans will be able to determine the appropriate method for detecting a particular label. Methods and devices that may be used in the diagnostic methods of the invention include, but are not limited to, computed tomography (CT), whole body scan such as position emission tomography (PET), magnetic resonance imaging (MRI), and sonography.

In a specific embodiment, the molecule is labeled with a radioisotope and is detected in the patient using a radiation responsive surgical instrument (Thurston et al., U.S. Pat. No. 5,441,050). In another embodiment, the molecule is labeled with a fluorescent compound and is detected in the patient using a fluorescence responsive scanning instrument. In another embodiment, the molecule is labeled with a positron emitting metal and is detected in the patent using positron emission-tomography. In yet another embodiment, the molecule is labeled with a paramagnetic label and is detected in a patient using magnetic resonance imaging (MRI).

Kits

The present invention provides kits that can be used in the above methods. In one embodiment, a kit comprises an antibody of the invention, preferably a purified antibody, in one or more containers. In a specific embodiment, the kits of the present invention contain a substantially isolated polypeptide comprising an epitope which is specifically immunoreactive with an antibody included in the kit. Preferably, the kits of the present invention further comprise a control antibody which does not react with the polypeptide of interest. In another specific embodiment, the kits of the present invention contain a means for detecting the binding of an antibody to a polypeptide of interest (e.g., the antibody may be conjugated to a detectable substrate such as a fluorescent compound, an enzymatic substrate, a radioactive compound or a luminescent compound, or a second antibody which recognizes the first antibody may be conjugated to a detectable substrate).

In another specific embodiment of the present invention, the kit is a diagnostic kit for use in screening serum containing antibodies specific against proliferative and/or cancerous polynucleotides and polypeptides. Such a kit may include a control antibody that does not react with the polypeptide of interest. Such a kit may include a substantially isolated polypeptide antigen comprising an epitope which is specifically immunoreactive with at least one anti-polypeptide antigen antibody. Further, such a kit includes means for detecting the binding of said antibody to the antigen (e.g., the antibody may be conjugated to a fluorescent compound such as fluorescein or rhodamine which can be detected by flow cytometry). In specific embodiments, the kit may include a recombinantly produced or chemically synthesized polypeptide antigen. The polypeptide antigen of the kit may also be attached to a solid support.

In a more specific embodiment the detecting means of the above-described kit includes a solid support to which said polypeptide antigen is attached. Such a kit may also include a non-attached reporter-labeled anti-human antibody. In this embodiment, binding of the antibody to the polypeptide antigen can be detected by binding of the said reporter-labeled antibody.

In an additional embodiment, the invention includes a diagnostic kit for use in screening serum containing antigens of the polypeptide of the invention. The diagnostic kit includes a substantially isolated antibody specifically immunoreactive with polypeptide or polynucleotide antigens, and means for detecting the binding of the polynucleotide or polypeptide antigen to the antibody. In one embodiment, the antibody is attached to a solid support. In a specific embodiment, the antibody may be a monoclonal antibody. The detecting means of the kit may include a second, labeled monoclonal antibody. Alternatively, or in addition, the detecting means may include a labeled, competing antigen.

In one diagnostic configuration, test serum is reacted with a solid phase reagent having a surface-bound antigen obtained by the methods of the present invention. After binding with specific antigen antibody to the reagent and removing unbound serum components by washing, the reagent is reacted with reporter-labeled anti-human antibody to bind reporter to the reagent in proportion to the amount of bound anti-antigen antibody on the solid support. The reagent is again washed to remove unbound labeled antibody, and the amount of reporter associated with the reagent is determined. Typically, the reporter is an enzyme which is detected by incubating the solid phase in the presence of a suitable fluorometric, luminescent or colorimetric substrate (Sigma, St. Louis, Mo.).

The solid surface reagent in the above assay is prepared by known techniques for attaching protein material to solid support material, such as polymeric beads, dip sticks, 96-well plate or filter material. These attachment methods generally include non-specific adsorption of the protein to the support or covalent attachment of the protein, typically through a free amine group, to a chemically reactive group on the solid support, such as an activated carboxyl, hydroxyl, or aldehyde group. Alternatively, streptavidin coated plates can be used in conjunction with biotinylated antigen(s).

Thus, the invention provides an assay system or kit for carrying out this diagnostic method. The kit generally includes a support with surface-bound recombinant antigens, and a reporter-labeled anti-human antibody for detecting surface-bound anti-antigen antibody.

Uses of the Polynucleotides

Each of the polynucleotides identified herein can be used in numerous ways as reagents. The following description should be considered exemplary and utilizes known techniques.

The polynucleotides of the present invention are useful for chromosome identification. There exists an ongoing need to identify new chromosome markers, since few chromosome marking reagents, based on actual sequence data (repeat polymorphisms), are presently available. Each sequence is specifically targeted to and can hybridize with a particular location on an individual human chromosome, thus each polynucleotide of the present invention can routinely be used as a chromosome marker using techniques known in the art. Table 1B.1, column 8 provides the chromosome location of some of the polynucleotides of the invention.

Briefly, sequences can be mapped to chromosomes by preparing PCR primers (preferably at least 15 bp (e.g., 15-25 bp) from the sequences shown in SEQ ID NO:X. Primers can optionally be selected using computer analysis so that primers do not span more than one predicted exon in the genomic DNA. These primers are then used for PCR screening of somatic cell hybrids containing individual human chromosomes. Only those hybrids containing the human gene corresponding to SEQ ID NO:X will yield an amplified fragment.

Similarly, somatic hybrids provide a rapid method of PCR mapping the polynucleotides to particular chromosomes. Three or more clones can be assigned per day using a single thermal cycler. Moreover, sublocalization of the polynucleotides can be achieved with panels of specific chromosome fragments. Other gene mapping strategies that can be used include in situ hybridization, prescreening with labeled flow-sorted chromosomes, preselection by hybridization to construct chromosome specific-cDNA libraries, and computer mapping techniques (See, e.g., Shuler, Trends Biotechnol 16:456-459 (1998) which is hereby incorporated by reference in its entirety).

Precise chromosomal location of the polynucleotides can also be achieved using fluorescence in situ hybridization (FISH) of a metaphase chromosomal spread. This technique uses polynucleotides as short as 500 or 600 bases; however, polynucleotides 2,000-4,000 bp are preferred. For a review of this technique, see Verma et al., "Human Chromosomes: a Manual of Basic Techniques," Pergamon Press, New York (1988).

For chromosome mapping, the polynucleotides can be used individually (to mark a single chromosome or a single site on that chromosome) or in panels (for marking multiple sites and/or multiple chromosomes).

Thus, the present invention also provides a method for chromosomal localization which involves (a) preparing PCR primers from the polynucleotide sequences in Table 1B and/ or Table 2 and SEQ ID NO:X and (b) screening somatic cell hybrids containing individual chromosomes.

The polynucleotides of the present invention would likewise be useful for radiation hybrid mapping, HAPPY mapping, and long range restriction mapping. For a review of these techniques and others known in the art, see, e.g. Dear, "Genome Mapping: A Practical Approach," IRL Press at Oxford University Press, London (1997); Aydin, J. Mol. Med. 77:691-694 (1999); Hacia et al., Mol. Psychiatry 3:483-492 (1998); Herrick et al., Chromosome Res. 7:409-423 (1999); Hamilton et al., Methods Cell Biol. 62:265-280 (2000); and/ or Ott, J. Hered. 90:68-70 (1999) each of which is hereby incorporated by reference in its entirety.

Once a polynucleotide has been mapped to a precise chromosomal location, the physical position of the polynucleotide can be used in linkage analysis. Linkage analysis establishes coinheritance between a chromosomal location and presentation of a particular disease. (Disease mapping data are found, for example, in V. McKusick, Mendelian Inheritance in Man (available on line through Johns Hopkins University Welch Medical Library)). Column 9 of Table 1B.1 provides an OMIM reference identification number of diseases associated with the cytologic band disclosed in column 8 of Table 1B.1, as determined using techniques described herein and by reference to Table 5. Assuming 1 megabase mapping resolution and one gene per 20 kb, a cDNA precisely localized to a chromosomal region associated with the disease could be one of 50-500 potential causative genes.

Thus, once coinheritance is established, differences in a polynucleotide of the invention and the corresponding gene between affected and unaffected individuals can be examined. First, visible structural alterations in the chromosomes, such as deletions or translocations, are examined in chromosome spreads or by PCR. If no structural alterations exist, the presence of point mutations are ascertained. Mutations observed in some or all affected individuals, but not in normal individuals, indicates that the mutation may cause the disease. However, complete sequencing of the polypeptide and the corresponding gene from several normal individuals is required to distinguish the mutation from a polymorphism. If a new polymorphism is identified, this polymorphic polypeptide can be used for further linkage analysis.

Furthermore, increased or decreased expression of the gene in affected individuals as compared to unaffected individuals can be assessed using the polynucleotides of the invention. Any of these alterations (altered expression, chromosomal rearrangement, or mutation) can be used as a diagnostic or prognostic marker. Diagnostic and prognostic methods, kits and reagents encompassed by the present invention are briefly described below and more thoroughly elsewhere herein (see e.g., the sections labeled "Antibodies", "Diagnostic Assays", and "Methods for Detecting Diseases").

Thus, the invention also provides a diagnostic method useful during diagnosis of a disorder, involving measuring the expression level of polynucleotides of the present invention in cells or body fluid from an individual and comparing the measured gene expression level with a standard level of polynucleotide expression level, whereby an increase or decrease in the gene expression level compared to the standard is indicative of a disorder. Additional non-limiting examples of diagnostic methods encompassed by the present invention are more thoroughly described elsewhere herein (see, e.g., Example 12).

In still another embodiment, the invention includes a kit for analyzing samples for the presence of proliferative and/or cancerous polynucleotides derived from a test subject. In a general embodiment, the kit includes at least one polynucleotide probe containing a nucleotide sequence that will specifically hybridize with a polynucleotide of the invention and a suitable container. In a specific embodiment, the kit includes two polynucleotide probes defining an internal region of the polynucleotide of the invention, where each probe has one strand containing a 31'mer-end internal to the region. In a further embodiment, the probes may be useful as primers for polymerase chain reaction amplification.

Where a diagnosis of a related disorder, including, for example, diagnosis of a tumor, has already been made according to conventional methods, the present invention is useful as a prognostic indicator, whereby patients exhibiting enhanced or depressed polynucleotide of the invention expression will experience a worse clinical outcome relative to patients expressing the gene at a level nearer the standard level.

By "measuring the expression level of polynucleotides of the invention" is intended qualitatively or quantitatively measuring or estimating the level of the polypeptide of the invention or the level of the mRNA encoding the polypeptide of the invention in a first biological sample either directly (e.g., by determining or estimating absolute protein level or mRNA level) or relatively (e.g., by comparing to the polypeptide level or mRNA level in a second biological sample). Preferably, the polypeptide level or mRNA level in the first biological sample is measured or estimated and compared to a standard polypeptide level or mRNA level, the standard being taken from a second biological sample obtained from an individual not having the related disorder or being determined by averaging levels from a population of individuals not having a related disorder. As will be appreciated in the art, once a standard polypeptide level or mRNA level is known, it can be used repeatedly as a standard for comparison.

By "biological sample" is intended any biological sample obtained from an individual, body fluid, cell line, tissue culture, or other source which contains polypeptide of the present invention or the corresponding mRNA. As indicated, biological samples include body fluids (such as semen, lymph, vaginal pool, sera, plasma, urine, synovial fluid and spinal fluid) which contain the polypeptide of the present invention, and tissue sources found to express the polypeptide of the present invention. Methods for obtaining tissue biopsies and body fluids from mammals are well known in the art. Where the biological sample is to include mRNA, a tissue biopsy is the preferred source.

The method(s) provided above may preferably be applied in a diagnostic method and/or kits in which polynucleotides and/or polypeptides of the invention are attached to a solid support. In one exemplary method, the support may be a "gene chip" or a "biological chip" as described in U.S. Pat. Nos. 5,837,832, 5,874,219, and 5,856,174. Further, such a gene chip with polynucleotides of the invention attached may be used to identify polymorphisms between the isolated polynucleotide sequences of the invention, with polynucleotides isolated from a test subject. The knowledge of such polymorphisms (i.e. their location, as well as, their existence) would be beneficial in identifying disease loci for many disorders, such as for example, in neural disorders, immune system disorders, muscular disorders, reproductive disorders, gastrointestinal disorders, pulmonary disorders, digestive disorders, metabolic disorders, cardiovascular disorders, renal disorders, proliferative disorders, and/or cancerous diseases and conditions. Such a method is described in U.S. Pat. Nos. 5,858,659 and 5,856,104. The US patents referenced supra are hereby incorporated by reference in their entirety herein.

The present invention encompasses polynucleotides of the present invention that are chemically synthesized, or reproduced as peptide nucleic acids (PNA), or according to other methods known in the art. The use of PNAs would serve as the preferred form if the polynucleotides of the invention are incorporated onto a solid support, or gene chip. For the purposes of the present invention, a peptide nucleic acid (PNA) is a polyamide type of DNA analog and the monomeric units for adenine, guanine, thymine and cytosine are available commercially (Perceptive Biosystems). Certain components of DNA, such as phosphorus, phosphorus oxides, or deoxyribose derivatives, are not present in PNAs. As disclosed by Nielsen et al., Science 254, 1497 (1991); and Egholm et al., Nature 365, 666 (1993), PNAs bind specifically and tightly to complementary DNA strands and are not degraded by nucleases. In fact, PNA binds more strongly to DNA than DNA itself does. This is probably because there is no electrostatic repulsion between the two strands, and also the polyamide backbone is more flexible. Because of this, PNA/DNA duplexes bind under a wider range of stringency conditions than DNA/DNA duplexes, making it easier to perform multiplex hybridization. Smaller probes can be used than with DNA due to the strong binding. In addition, it is more likely that single base mismatches can be determined with PNA/DNA hybridization because a single mismatch in a PNA/DNA 15-mer lowers the melting point (T.sub.m) by 8°-20° C., vs. 4°-16° C. for the DNA/DNA 15-mer duplex. Also, the absence of charge groups in PNA means that hybridization can be done at low ionic strengths and reduce possible interference by salt during the analysis.

The compounds of the present invention have uses which include, but are not limited to, detecting cancer in mammals. In particular the invention is useful during diagnosis of pathological cell proliferative neoplasias which include, but are not limited to: acute myelogenous leukemias including acute monocytic leukemia, acute myeloblastic leukemia, acute promyelocytic leukemia, acute myelomonocytic leukemia, acute erythroleukemia, acute megakaryocytic leukemia, and acute undifferentiated leukemia, etc.; and chronic myelogenous leukemias including chronic myelomonocytic leukemia, chronic granulocytic leukemia, etc. Preferred mammals include monkeys, apes, cats, dogs, cows, pigs, horses, rabbits and humans. Particularly preferred are humans.

Pathological cell proliferative disorders are often associated with inappropriate activation of proto-oncogenes. (Gelmann, E. P. et al., "The Etiology of Acute Leukemia: Molecular Genetics and Viral Oncology," in Neoplastic Diseases of the Blood, Vol 1., Wiernik, P. H. et al. eds., 161-182 (1985)). Neoplasias are now believed to result from the qualitative alteration of a normal cellular gene product, or from the quantitative modification of gene expression by insertion into the chromosome of a viral sequence, by chromosomal translocation of a gene to a more actively transcribed region, or by some other mechanism. (Gelmann et al., supra) It is likely that mutated or altered expression of specific genes is involved in the pathogenesis of some leukemias, among other tissues and cell types. (Gelmann et al., supra) Indeed, the human counterparts of the oncogenes involved in some animal neoplasias have been amplified or translocated in some cases of human leukemia and carcinoma. (Gelmann et al., supra)

For example, c-myc expression is highly amplified in the non-lymphocytic leukemia cell line HL-60. When HL-60 cells are chemically induced to stop proliferation, the level of c-myc is found to be downregulated. (International Publication Number WO 91/15580). However, it has been shown that exposure of HL-60 cells to a DNA construct that is complementary to the 5' end of c-myc or c-myb blocks translation of the corresponding mRNAs which downregulates expression of the c-myc or c-myb proteins and causes arrest of cell proliferation and differentiation of the treated cells. (International Publication Number WO 91/15580; Wickstrom et al., Proc. Natl. Acad. Sci. 85:1028 (1988); Anfossi et al., Proc. Natl. Acad. Sci. 86:3379 (1989)). However, the skilled artisan would appreciate the present invention's usefulness is not be limited to treatment, prevention, and/or prognosis of proliferative disorders of cells and tissues of hematopoietic origin, in light of the numerous cells and cell types of varying origins which are known to exhibit proliferative phenotypes.

In addition to the foregoing, a polynucleotide of the present invention can be used to control gene expression through triple helix formation or through antisense DNA or RNA. Antisense techniques are discussed, for example, in Okano, J. Neurochem. 56: 560 (1991); "Oligodeoxynucleotides as Antisense Inhibitors of Gene Expression, CRC Press, Boca Raton, Fla. (1988). Triple helix formation is discussed in, for instance Lee et al., Nucleic Acids Research 6: 3073 (1979); Cooney et al., Science 241: 456 (1988); and Dervan et al., Science 251: 1360 (1991). Both methods rely on binding of the polynucleotide to a complementary DNA or RNA. For these techniques, preferred polynucleotides are usually oligonucleotides 20 to 40 bases in length and complementary to either the region of the gene involved in transcription (triple helix—see Lee et al., Nucl. Acids Res. 6:3073 (1979); Cooney et al., Science 241:456 (1988); and Dervan et al., Science 251:1360 (1991)) or to the mRNA itself (antisense—Okano, J. Neurochem. 56:560 (1991); Oligodeoxy-nucleotides as Antisense Inhibitors of Gene Expression, CRC Press, Boca Raton, Fla. (1988)). Triple helix formation optimally results in a shut-off of RNA transcription from DNA, while antisense RNA hybridization blocks translation of an mRNA molecule into polypeptide. The oligonucleotide described above can also be delivered to cells such that the antisense RNA or DNA may be expressed in vivo to inhibit production of polypeptide of the present invention antigens. Both techniques are effective in model systems, and the information disclosed herein can be used to design antisense or triple helix polynucleotides in an effort to treat disease, and in particular, for the treatment of proliferative diseases and/or conditions. Non-limiting antisense and triple helix methods encompassed by the present invention are more thoroughly described elsewhere herein (see, e.g., the section labeled "Antisense and Ribozyme (Antagonists)").

Polynucleotides of the present invention are also useful in gene therapy. One goal of gene therapy is to insert a normal gene into an organism having a defective gene, in an effort to correct the genetic defect. The polynucleotides disclosed in the present invention offer a means of targeting such genetic defects in a highly accurate manner. Another goal is to insert a new gene that was not present in the host genome, thereby producing a new trait in the host cell. Additional non-limiting examples of gene therapy methods encompassed by the present invention are more thoroughly described elsewhere herein (see, e.g., the sections labeled "Gene Therapy Methods", and Examples 16, 17 and 18).

The polynucleotides are also useful for identifying individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identifying personnel. This method does not suffer from the current limitations of "Dog Tags" which can be lost, switched, or stolen, making positive identification difficult. The polynucleotides of the present invention can be used as additional DNA markers for RFLP.

The polynucleotides of the present invention can also be used as an alternative to RFLP, by determining the actual base-by-base DNA sequence of selected portions of an individual's genome. These sequences can be used to prepare PCR primers for amplifying and isolating such selected DNA, which can then be sequenced. Using this technique, individuals can be identified because each individual will have a unique set of DNA sequences. Once an unique ID database is established for an individual, positive identification of that individual, living or dead, can be made from extremely small tissue samples.

Forensic biology also benefits from using DNA-based identification techniques as disclosed herein. DNA sequences taken from very small biological samples such as tissues, e.g., hair or skin, or body fluids, e.g., blood, saliva, semen, synovial fluid, amniotic fluid, breast milk, lymph, pulmonary sputum or surfactant, urine, fecal matter, etc., can be amplified using PCR. In one prior art technique, gene sequences amplified from polymorphic loci, such as DQa class II HLA gene, are used in forensic biology to identify individuals. (Erlich, H., PCR Technology, Freeman and Co. (1992)). Once these specific polymorphic loci are amplified, they are digested with one or more restriction enzymes, yielding an identifying set of bands on a Southern blot probed with DNA corresponding to the DQa class II HLA gene. Similarly, polynucleotides of the present invention can be used as polymorphic markers for forensic purposes.

There is also a need for reagents capable of identifying the source of a particular tissue. Such need arises, for example, in forensics when presented with tissue of unknown origin. Appropriate reagents can comprise, for example, DNA probes or primers prepared from the sequences of the present invention, specific to tissues, including but not limited to those shown in Table 1B. Panels of such reagents can identify tissue by species and/or by organ type. In a similar fashion, these reagents can be used to screen tissue cultures for contamination. Additional non-limiting examples of such uses are further described herein.

The polynucleotides of the present invention are also useful as hybridization probes for differential identification of the tissue(s) or cell type(s) present in a biological sample. Similarly, polypeptides and antibodies directed to polypeptides of the present invention are useful to provide immunological probes for differential identification of the tissue(s) (e.g., immunohistochemistry assays) or cell type(s) (e.g., immunocytochemistry assays). In addition, for a number of disorders of the above tissues or cells, significantly higher or lower levels of gene expression of the polynucleotides/polypeptides of the present invention may be detected in certain tissues (e.g., tissues expressing polypeptides and/or polynucleotides of the present invention, for example, those disclosed in column 5 of Table 1B.2, and/or cancerous and/or wounded tissues) or bodily fluids (e.g., semen, lymph, vaginal pool, serum, plasma, urine, synovial fluid or spinal fluid) taken from an individual having such a disorder, relative to a "standard" gene expression level, i.e., the expression level in healthy tissue from an individual not having the disorder.

Thus, the invention provides a diagnostic method of a disorder, which involves: (a) assaying gene expression level in cells or body fluid of an individual; (b) comparing the gene expression level with a standard gene expression level, whereby an increase or decrease in the assayed gene expression level compared to the standard expression level is indicative of a disorder.

In the very least, the polynucleotides of the present invention can be used as molecular weight markers on Southern gels, as diagnostic probes for the presence of a specific mRNA in a particular cell type, as a probe to "subtract-out" known sequences in the process of discovering novel polynucleotides, for selecting and making oligomers for attachment to a "gene chip" or other support, to raise anti-DNA antibodies using DNA immunization techniques, and as an antigen to elicit an immune response.

Uses of the Polypeptides

Each of the polypeptides identified herein can be used in numerous ways. The following description should be considered exemplary and utilizes known techniques.

Polypeptides and antibodies directed to polypeptides of the present invention are useful to provide immunological probes for differential identification of the tissue(s) (e.g., immunohistochemistry assays such as, for example, ABC immunoperoxidase (Hsu et al., J. Histochem. Cytochem. 29:577-580 (1981)) or cell type(s) (e.g., immunocytochemistry assays).

Antibodies can be used to assay levels of polypeptides encoded by polynucleotides of the invention in a biological sample using classical immunohistological methods known to those of skill in the art (e.g., see Jalkanen, et al., J. Cell. Biol. 101:976-985 (1985); Jalkanen, et al., J. Cell. Biol. 105: 3087-3096 (1987)). Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase; radioisotopes, such as iodine ($^{131}$I, $^{125}$I, $^{123}$I, $^{121}$I), carbon ($^{14}$C), sulfur ($^{35}$S), tritium ($^{3}$H), indium ($^{115m}$In, $^{113m}$In, $^{112}$In, $^{111}$In), and technetium ($^{99}$Tc, $^{99m}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru; luminescent labels, such as luminol; and fluorescent labels, such as fluorescein and rhodamine, and biotin.

In addition to assaying levels of polypeptide of the present invention in a biological sample, proteins can also be detected in vivo by imaging. Antibody labels or markers for in vivo imaging of protein include those detectable by X-radiography, NMR or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the antibody by labeling of nutrients for the relevant hybridoma.

A protein-specific antibody or antibody fragment which has been labeled with an appropriate detectable imaging moiety, such as a radioisotope (for example, $^{131}$I, $^{112}$In, $^{99m}$Tc, ($^{131}$I, $^{125}$I, $^{123}$I, $^{121}$I), carbon ($^{14}$C), sulfur ($^{35}$S), tritium ($^{3}$H), indium ($^{115m}$In, $^{113m}$In, $^{112}$In, $^{111}$In), and technetium ($^{99}$Tc, $^{99m}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F, $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru), a radio-opaque substance, or a material detectable by nuclear magnetic resonance, is introduced (for example, parenterally, subcutaneously or intraperitoneally) into the mammal to be examined for immune system disorder. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99m}$Tc. The labeled antibody or antibody fragment will then preferentially accumulate at the location of cells which express the polypeptide encoded by a polynucleotide of the invention. In vivo tumor imaging is described in S. W. Burchiel et al., "Immunopharmacokinetics of Radiolabeled Antibodies and Their Fragments" (Chapter 13 in *Tumor Imaging: The Radiochemical Detection of Cancer*, S. W. Burchiel and B. A. Rhodes, eds., Masson Publishing Inc. (1982)).

In one embodiment, the invention provides a method for the specific delivery of compositions of the invention to cells by administering polypeptides of the invention (e.g., polypeptides encoded by polynucleotides of the invention and/or antibodies) that are associated with heterologous polypeptides or nucleic acids. In one example, the invention provides a method for delivering a therapeutic protein into the targeted cell. In another example, the invention provides a method for delivering a single stranded nucleic acid (e.g., antisense or ribozymes) or double stranded nucleic acid (e.g., DNA that can integrate into the cell's genome or replicate episomally and that can be transcribed) into the targeted cell.

In another embodiment, the invention provides a method for the specific destruction of cells (e.g., the destruction of tumor cells) by administering polypeptides of the invention in association with toxins or cytotoxic prodrugs.

By "toxin" is meant one or more compounds that bind and activate endogenous cytotoxic effector systems, radioisotopes, holotoxins, modified toxins, catalytic subunits of toxins, or any molecules or enzymes not normally present in or on the surface of a cell that under defined conditions cause the cell's death. Toxins that may be used according to the methods of the invention include, but are not limited to, radioisotopes known in the art, compounds such as, for example, antibodies (or complement fixing containing portions thereof) that bind an inherent or induced endogenous cytotoxic effector system, thymidine kinase, endonuclease, RNAse, alpha toxin, ricin, abrin, *Pseudomonas* exotoxin A, diphtheria toxin, saporin, momordin, gelonin, pokeweed antiviral protein, alpha-sarcin and cholera toxin. "Toxin" also includes a cytostatic or cytocidal agent, a therapeutic agent or a radioactive metal ion, e.g., alpha-emitters such as, for example, $^{213}$Bi, or other radioisotopes such as, for example, $^{103}$Pd, $^{133}$Xe, $^{131}$I, $^{68}$Ge, $^{57}$Co, $^{65}$Zn, $^{85}$Sr, $^{32}$P, $^{35}$S, $^{90}$Y, $^{153}$Sm, $^{153}$Gd, $^{169}$Yb, $^{51}$Cr, $^{54}$Mn, $^{75}$Se, $^{113}$Sn, $^{90}$Yttrium, $^{117}$Tin, $^{186}$Rhenium, $^{166}$Holmium, and $^{188}$Rhenium; luminescent labels, such as luminol; and fluorescent labels, such as fluorescein and rhodamine, and biotin. In a specific embodiment, the invention provides a method for the specific destruction of cells (e.g., the destruction of tumor cells) by administering polypeptides of the invention or antibodies of the invention in association with the radioisotope $^{90}$Y. In another specific embodiment, the invention provides a method for the specific destruction of cells (e.g., the destruction of tumor cells) by administering polypeptides of the invention or antibodies of the invention in association with the radioisotope $^{111}$In. In a further specific embodiment, the invention provides a method for the specific destruction of cells (e.g., the destruction of tumor cells) by administering polypeptides of the invention or antibodies of the invention in association with the radioisotope $^{131}$I.

Techniques known in the art may be applied to label polypeptides of the invention (including antibodies). Such techniques include, but are not limited to, the use of bifunctional conjugating agents (see e.g., U.S. Pat. Nos. 5,756,065; 5,714,631; 5,696,239; 5,652,361; 5,505,931; 5,489,425; 5,435,990; 5,428,139; 5,342,604; 5,274,119; 4,994,560; and 5,808,003; the contents of each of which are hereby incorporated by reference in its entirety).

Thus, the invention provides a diagnostic method of a disorder, which involves (a) assaying the expression level of a polypeptide of the present invention in cells or body fluid of an individual; and (b) comparing the assayed polypeptide expression level with a standard polypeptide expression level, whereby an increase or decrease in the assayed polypeptide expression level compared to the standard expression level is indicative of a disorder. With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Moreover, polypeptides of the present invention can be used to treat or prevent diseases or conditions such as, for example, neural disorders, immune system disorders, muscular disorders, reproductive disorders, gastrointestinal disorders, pulmonary disorders, cardiovascular disorders, renal disorders, proliferative disorders, and/or cancerous diseases and conditions. For example, patients can be administered a polypeptide of the present invention in an effort to replace absent or decreased levels of the polypeptide (e.g., insulin), to supplement absent or decreased levels of a different polypeptide (e.g., hemoglobin S for hemoglobin B, SOD, catalase, DNA repair proteins), to inhibit the activity of a polypeptide (e.g., an oncogene or tumor supressor), to activate the activity of a polypeptide (e.g., by binding to a receptor), to reduce the activity of a membrane bound receptor by competing with it for free ligand (e.g., soluble TNF receptors used in reducing inflammation), or to bring about a desired response (e.g., blood vessel growth inhibition, enhancement of the immune response to proliferative cells or tissues).

Similarly, antibodies directed to a polypeptide of the present invention can also be used to treat disease (as described supra, and elsewhere herein). For example, administration of an antibody directed to a polypeptide of the present invention can bind, and/or neutralize the polypeptide, and/or reduce overproduction of the polypeptide. Similarly, administration of an antibody can activate the polypeptide, such as by binding to a polypeptide bound to a membrane (receptor).

At the very least, the polypeptides of the present invention can be used as molecular weight markers on SDS-PAGE gels or on molecular sieve gel filtration columns using methods well known to those of skill in the art. Polypeptides can also be used to raise antibodies, which in turn are used to measure protein expression from a recombinant cell, as a way of assessing transformation of the host cell. Moreover, the polypeptides of the present invention can be used to test the biological activities described herein.

Diagnostic Assays

The compounds of the present invention are useful for diagnosis, treatment, prevention and/or prognosis of various disorders in mammals, preferably humans. Such disorders include, but are not limited to, those described in the legends for Tables 1D and 1E and as indicated in the "Preferred Indications" columns in Table 1D and Table 1E; and, also as described herein under the section heading "Biological Activities".

For a number of disorders, substantially altered (increased or decreased) levels of gene expression can be detected in tissues, cells or bodily fluids (e.g., sera, plasma, urine, semen, synovial fluid or spinal fluid) taken from an individual having such a disorder, relative to a "standard" gene expression level, that is, the expression level in tissues or bodily fluids from an individual not having the disorder. Thus, the invention provides a diagnostic method useful during diagnosis of a disorder, which involves measuring the expression level of the gene encoding the polypeptide in tissues, cells or body fluid from an individual and comparing the measured gene expression level with a standard gene expression level, whereby an increase or decrease in the gene expression level(s) compared to the standard is indicative of a disorder. These diagnostic assays may be performed in vivo or in vitro, such as, for example, on blood samples, biopsy tissue or autopsy tissue.

The present invention is also useful as a prognostic indicator, whereby patients exhibiting enhanced or depressed gene expression will experience a worse clinical outcome relative to patients expressing the gene at a level nearer the standard level.

In certain embodiments, a polypeptide of the invention, or polynucleotides, antibodies, agonists, or antagonists corresponding to that polypeptide, may be used to diagnose and/or prognose diseases and/or disorders associated with the tissue(s) in which the polypeptide of the invention is expressed, including one, two, three, four, five, or more tissues disclosed in Table 1B.2, column 5 (Tissue Distribution Library Code).

By "assaying the expression level of the gene encoding the polypeptide" is intended qualitatively or quantitatively measuring or estimating the level of the polypeptide of the invention or the level of the mRNA encoding the polypeptide of the invention in a first biological sample either directly (e.g., by determining or estimating absolute protein level or mRNA level) or relatively (e.g., by comparing to the polypeptide level or mRNA level in a second biological sample). Preferably, the polypeptide expression level or mRNA level in the first biological sample is measured or estimated and compared to a standard polypeptide level or mRNA level, the standard being taken from a second biological sample obtained from an individual not having the disorder or being determined by averaging levels from a population of individuals not having the disorder. As will be appreciated in the art, once a standard polypeptide level or mRNA level is known, it can be used repeatedly as a standard for comparison.

By "biological sample" is intended any biological sample obtained from an individual, cell line, tissue culture, or other source containing polypeptides of the invention (including portions thereof) or mRNA. As indicated, biological samples include body fluids (such as sera, plasma, urine, synovial fluid and spinal fluid) and tissue sources found to express the full length or fragments thereof of a polypeptide or mRNA. Methods for obtaining tissue biopsies and body fluids from mammals are well known in the art. Where the biological sample is to include mRNA, a tissue biopsy is the preferred source.

Total cellular RNA can be isolated from a biological sample using any suitable technique such as the single-step guanidinium-thiocyanate-phenol-chloroform method described in Chomczynski and Sacchi, Anal. Biochem. 162: 156-159 (1987). Levels of mRNA encoding the polypeptides of the invention are then assayed using any appropriate method. These include Northern blot analysis, S1 nuclease mapping, the polymerase chain reaction (PCR), reverse transcription in combination with the polymerase chain reaction (RT-PCR), and reverse transcription in combination with the ligase chain reaction (RT-LCR).

The present invention also relates to diagnostic assays such as quantitative and diagnostic assays for detecting levels of polypeptides of the invention, in a biological sample (e.g., cells and tissues), including determination of normal and abnormal levels of polypeptides. Thus, for instance, a diagnostic assay in accordance with the invention for detecting over-expression of polypeptides of the invention compared to normal control tissue samples may be used to detect the presence of tumors. Assay techniques that can be used to determine levels of a polypeptide, such as a polypeptide of the present invention in a sample derived from a host are well-known to those of skill in the art. Such assay methods include radioimmunoassays, competitive-binding assays, Western Blot analysis and ELISA assays. Assaying polypeptide levels in a biological sample can occur using any art-known method.

Assaying polypeptide levels in a biological sample can occur using antibody-based techniques. For example, polypeptide expression in tissues can be studied with classical immunohistological methods (Jalkanen et al., J. Cell. Biol. 101:976-985 (1985); Jalkanen, M., et al., J. Cell. Biol. 105:3087-3096 (1987)). Other antibody-based methods useful for detecting polypeptide gene expression include immunoassays, such as the enzyme linked immunosorbent assay (ELISA) and the radioimmunoassay (RIA). Suitable antibody assay labels are known in the art and include enzyme labels, such as, glucose oxidase, and radioisotopes, such as iodine ($^{125}$I, $^{121}$I), carbon ($^{14}$C), sulfur ($^{35}$S), tritium ($^{3}$H), indium ($^{112}$In), and technetium ($^{99m}$Tc), and fluorescent labels, such as fluorescein and rhodamine, and biotin.

The tissue or cell type to be analyzed will generally include those which are known, or suspected, to express the gene of interest (such as, for example, cancer). The protein isolation methods employed herein may, for example, be such as those described in Harlow and Lane (Harlow, E. and Lane, D., 1988, "Antibodies: A Laboratory Manual", Cold Spring Harbor Laboratory Press, Cold Spring Harbor, N.Y.), which is incorporated herein by reference in its entirety. The isolated cells can be derived from cell culture or from a patient. The analysis of cells taken from culture may be a necessary step in the assessment of cells that could be used as part of a cell-based gene therapy technique or, alternatively, to test the effect of compounds on the expression of the gene.

For example, antibodies, or fragments of antibodies, such as those described herein, may be used to quantitatively or qualitatively detect the presence of gene products or conserved variants or peptide fragments thereof. This can be accomplished, for example, by immunofluorescence techniques employing a fluorescently labeled antibody coupled with light microscopic, flow cytometric, or fluorimetric detection.

In a preferred embodiment, antibodies, or fragments of antibodies directed to any one or all of the predicted epitope domains of the polypeptides of the invention (shown in column 7 of Table 1B.1) may be used to quantitatively or qualitatively detect the presence of gene products or conserved variants or peptide fragments thereof. This can be accomplished, for example, by immunofluorescence techniques employing a fluorescently labeled antibody coupled with light microscopic, flow cytometric, or fluorimetric detection.

In an additional preferred embodiment, antibodies, or fragments of antibodies directed to a conformational epitope of a polypeptide of the invention may be used to quantitatively or qualitatively detect the presence of gene products or conserved variants or peptide fragments thereof. This can be accomplished, for example, by immunofluorescence techniques employing a fluorescently labeled antibody coupled with light microscopic, flow cytometric, or fluorimetric detection.

The antibodies (or fragments thereof), and/or polypeptides of the present invention may, additionally, be employed histologically, as in immunofluorescence, immunoelectron microscopy or non-immunological assays, for in situ detection of gene products or conserved variants or peptide fragments thereof. In situ detection may be accomplished by removing a histological specimen from a patient, and applying thereto a labeled antibody or polypeptide of the present invention. The antibody (or fragment thereof) or polypeptide is preferably applied by overlaying the labeled antibody (or fragment) onto a biological sample. Through the use of such a procedure, it is possible to determine not only the presence of the gene product, or conserved variants or peptide fragments, or polypeptide binding, but also its distribution in the examined tissue. Using the present invention, those of ordinary skill will readily perceive that any of a wide variety of histological methods (such as staining procedures) can be modified in order to achieve such in situ detection.

Immunoassays and non-immunoassays for gene products or conserved variants or peptide fragments thereof will typically comprise incubating a sample, such as a biological fluid, a tissue extract, freshly harvested cells, or lysates of cells which have been incubated in cell culture, in the presence of a detectably labeled antibody capable of binding gene products or conserved variants or peptide fragments thereof, and detecting the bound antibody by any of a number of techniques well-known in the art.

The biological sample may be brought in contact with and immobilized onto a solid phase support or carrier such as nitrocellulose, or other solid support which is capable of immobilizing cells, cell particles or soluble proteins. The support may then be washed with suitable buffers followed by treatment with the detectably labeled antibody or detectable polypeptide of the invention. The solid phase support may then be washed with the buffer a second time to remove unbound antibody or polypeptide. Optionally the antibody is subsequently labeled. The amount of bound label on solid support may then be detected by conventional means.

By "solid phase support or carrier" is intended any support capable of binding an antigen or an antibody. Well-known supports or carriers include glass, polystyrene, polypropylene, polyethylene, dextran, nylon, amylases, natural and modified celluloses, polyacrylamides, gabbros, and magnetite. The nature of the carrier can be either soluble to some extent or insoluble for the purposes of the present invention. The support material may have virtually any possible structural configuration so long as the coupled molecule is capable of binding to an antigen or antibody. Thus, the support configuration may be spherical, as in a bead, or cylindrical, as in the inside surface of a test tube, or the external surface of a rod. Alternatively, the surface may be flat such as a sheet, test strip, etc. Preferred supports include polystyrene beads. Those skilled in the art will know many other suitable carriers for binding antibody or antigen, or will be able to ascertain the same by use of routine experimentation.

The binding activity of a given lot of antibody or antigen polypeptide may be determined according to well known methods. Those skilled in the art will be able to determine operative and optimal assay conditions for each determination by employing routine experimentation.

In addition to assaying polypeptide levels or polynucleotide levels in a biological sample obtained from an individual, polypeptide or polynucleotide can also be detected in vivo by imaging. For example, in one embodiment of the invention, polypeptides and/or antibodies of the invention are used to image diseased cells, such as neoplasms. In another embodiment, polynucleotides of the invention (e.g., polynucleotides complementary to all or a portion of an mRNA) and/or antibodies (e.g., antibodies directed to any one or a combination of the epitopes of a polypeptide of the invention, antibodies directed to a conformational epitope of a polypeptide of the invention, or antibodies directed to the full length polypeptide expressed on the cell surface of a mammalian cell) are used to image diseased or neoplastic cells.

Antibody labels or markers for in vivo imaging of polypeptides of the invention include those detectable by X-radiography, NMR, MRI, CAT-scans or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the antibody by labeling of nutrients for the relevant hybridoma. Where in vivo imaging is used to detect enhanced levels of polypeptides for diagnosis in humans, it may be preferable to use human antibodies or "humanized" chimeric monoclonal antibodies. Such antibodies can be produced using techniques described herein or otherwise known in the art. For example methods for producing chimeric antibodies are known in the art. See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).

Additionally, any polypeptides of the invention whose presence can be detected, can be administered. For example, polypeptides of the invention labeled with a radio-opaque or other appropriate compound can be administered and visualized in vivo, as discussed, above for labeled antibodies. Further, such polypeptides can be utilized for in vitro diagnostic procedures.

A polypeptide-specific antibody or antibody fragment which has been labeled with an appropriate detectable imaging moiety, such as a radioisotope (for example, $^{131}$I, $^{112}$In, $^{99m}$Tc), a radio-opaque substance, or a material detectable by nuclear magnetic resonance, is introduced (for example, parenterally, subcutaneously or intraperitoneally) into the mammal to be examined for a disorder. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99m}$Tc. The labeled antibody or antibody fragment will then preferentially accumulate at the location of cells which contain the antigenic protein. In vivo tumor imaging is described in S. W. Burchiel et al., "Immunopharmacokinetics of Radiolabeled Antibodies and Their Fragments" (Chapter 13 in Tumor Imaging: The Radiochemical Detection of Cancer, S. W. Burchiel and B. A. Rhodes, eds., Masson Publishing Inc. (1982)).

With respect to antibodies, one of the ways in which an antibody of the present invention can be detectably labeled is by linking the same to a reporter enzyme and using the linked product in an enzyme immunoassay (EIA) (Voller, A., "The Enzyme Linked Immunosorbent Assay (ELISA)", 1978, Diagnostic Horizons 2:1-7, Microbiological Associates Quarterly Publication, Walkersville, Md.); Voller et al., J. Clin. Pathol. 31:507-520 (1978); Butler, J. E., Meth. Enzymol. 73:482-523 (1981); Maggio, E. (ed.), 1980, Enzyme Immunoassay, CRC Press, Boca Raton, Fla.; Ishikawa, E. et al., (eds.), 1981, Enzyme Immunoassay, Kgaku Shoin, Tokyo). The reporter enzyme which is bound to the antibody will react with an appropriate substrate, preferably a chromogenic substrate, in such a manner as to produce a chemical moiety which can be detected, for example, by spectrophotometric, fluorimetric or by visual means. Reporter enzymes which can be used to detectably label the antibody include, but are not limited to, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase. Additionally, the detection can be accomplished by colorimetric methods which employ a chromogenic substrate for the reporter enzyme. Detection may also be accomplished by visual comparison of the extent of enzymatic reaction of a substrate in comparison with similarly prepared standards.

Detection may also be accomplished using any of a variety of other immunoassays. For example, by radioactively labeling the antibodies or antibody fragments, it is possible to detect polypeptides through the use of a radioimmunoassay (RIA) (see, for example, Weintraub, B., Principles of Radioimmunoassays, Seventh Training Course on Radioligand Assay Techniques, The Endocrine Society, March, 1986, which is incorporated by reference herein). The radioactive isotope can be detected by means including, but not limited to, a gamma counter, a scintillation counter, or autoradiography.

It is also possible to label the antibody with a fluorescent compound. When the fluorescently labeled antibody is exposed to light of the proper wave length, its presence can then be detected due to fluorescence. Among the most commonly used fluorescent labeling compounds are fluorescein isothiocyanate, rhodamine, phycoerythrin, phycocyanin, allophycocyanin, ophthaldehyde and fluorescamine.

The antibody can also be detectably labeled using fluorescence emitting metals such as $^{152}$Eu, or others of the lanthanide series. These metals can be attached to the antibody using such metal chelating groups as diethylenetriaminepentacetic acid (DTPA) or ethylenediaminetetraacetic acid (EDTA).

The antibody also can be detectably labeled by coupling it to a chemiluminescent compound. The presence of the chemiluminescent-tagged antibody is then determined by detecting the presence of luminescence that arises during the course of a chemical reaction. Examples of particularly useful chemiluminescent labeling compounds are luminol, isoluminol, theromatic acridinium ester, imidazole, acridinium salt and oxalate ester.

Likewise, a bioluminescent compound may be used to label the antibody of the present invention. Bioluminescence is a type of chemiluminescence found in biological systems in, which a catalytic protein increases the efficiency of the chemiluminescent reaction. The presence of a bioluminescent protein is determined by detecting the presence of luminescence. Important bioluminescent compounds for purposes of labeling are luciferin, luciferase and aequorin.

Methods for Detecting Diseases

In general, a disease may be detected in a patient based on the presence of one or more proteins of the invention and/or polynucleotides encoding such proteins in a biological sample (for example, blood, sera, urine, and/or tumor biopsies) obtained from the patient. In other words, such proteins may be used as markers to indicate the presence or absence of a disease or disorder, including cancer and/or as described elsewhere herein. In addition, such proteins may be useful for the detection of other diseases and cancers. The binding agents provided herein generally permit detection of the level of antigen that binds to the agent in the biological sample. Polynucleotide primers and probes may be used to detect the level of mRNA encoding polypeptides of the invention, which is also indicative of the presence or absence of a disease or disorder, including cancer. In general, polypeptides of the invention should be present at a level that is at least three fold higher in diseased tissue than in normal tissue.

There are a variety of assay formats known to those of ordinary skill in the art for using a binding agent to detect polypeptide markers in a sample. See, e.g., Harlow and Lane, supra. In general, the presence or absence of a disease in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of a binding agent(s) immobilized on a solid support to bind to and remove the polypeptide of the invention from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include polypeptides of the invention and portions thereof, or antibodies, to which the binding agent binds, as described above.

The solid support may be any material known to those of skill in the art to which polypeptides of the invention may be attached. For example, the solid support may be a test well in a microtiter plate or a nitrocellulose or other suitable membrane. Alternatively, the support may be a bead or disc, such as glass fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for the suitable amount of time. The contact time varies with temperature, but is typically between about 1 hour and about 1 day. In general, contacting a well of plastic microtiter plate (such as polystyrene or polyvinylchloride) with an amount of binding agent ranging from about 10 ng to about 10 ug, and preferably about 100 ng to about 1 ug, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12-A13).

Gene Therapy Methods

Also encompassed by the invention are gene therapy methods for treating or preventing disorders, diseases and conditions. The gene therapy methods relate to the introduction of nucleic acid (DNA, RNA and antisense DNA or RNA) sequences into an animal to achieve expression of the polypeptide of the present invention. This method requires a polynucleotide which codes for a polypeptide of the present invention operatively linked to a promoter and any other genetic elements necessary for the expression of the polypeptide by the target tissue. Such gene therapy and delivery techniques are known in the art, see, for example, WO90/11092, which is herein incorporated by reference.

Thus, for example, cells from a patient may be engineered with a polynucleotide (DNA or RNA) comprising a promoter operably linked to a polynucleotide of the present invention ex vivo, with the engineered cells then being provided to a patient to be treated with the polypeptide of the present invention. Such methods are well-known in the art. For example, see Belldegrun, A., et al., J. Natl. Cancer Inst. 85: 207-216 (1993); Ferrantini, M. et al., Cancer Research 53: 1107-1112 (1993); Ferrantini, M. et al., J. Immunology 153: 4604-4615 (1994); Kaido, T., et al., Int. J. Cancer 60: 221-229 (1995); Ogura, H., et al., Cancer Research 50: 5102-5106 (1990); Santodonato, L., et al., Human Gene Therapy 7:1-10 (1996); Santodonato, L., et al., Gene Therapy 4:1246-1255 (1997); and Zhang, J.-F. et al., Cancer Gene Therapy 3: 31-38 (1996)), which are herein incorporated by reference. In one embodiment, the cells which are engineered are arterial cells. The arterial cells may be reintroduced into the patient through direct injection to the artery, the tissues surrounding the artery, or through catheter injection.

As discussed in more detail below, the polynucleotide constructs can be delivered by any method that delivers injectable materials to the cells of an animal, such as, injection into the interstitial space of tissues (heart, muscle, skin, lung, liver, and the like). The polynucleotide constructs may be delivered in a pharmaceutically acceptable liquid or aqueous carrier.

In one embodiment, the polynucleotide of the present invention is delivered as a naked polynucleotide. The term "naked" polynucleotide, DNA or RNA refers to sequences that are free from any delivery vehicle that acts to assist, promote or facilitate entry into the cell, including viral sequences, viral particles, liposome formulations, LIPOFECTIN™ or precipitating agents and the like. However, the polynucleotide of the present invention can also be delivered in liposome formulations and LIPOFECTIN™ formulations and the like can be prepared by methods well known to those skilled in the art. Such methods are described, for example, in U.S. Pat. Nos. 5,593,972, 5,589,466, and 5,580,859, which are herein incorporated by reference.

The polynucleotide vector constructs used in the gene therapy method are preferably constructs that will not integrate into the host genome nor will they contain sequences that allow for replication. Appropriate vectors include pWL-NEO, pSV2CAT, pOG44, pXT1 and pSG available from Stratagene; pSVK3, pBPV, pMSG and pSVL available from Pharmacia; and pEF1V5, pcDNA3.1, and pRc/CMV2 available from Invitrogen. Other suitable vectors will be readily apparent to the skilled artisan.

Any strong promoter known to those skilled in the art can be used for driving the expression of the polynucleotide sequence. Suitable promoters include adenoviral promoters, such as the adenoviral major late promoter; or heterologous promoters, such as the cytomegalovirus (CMV) promoter; the respiratory syncytial virus (RSV) promoter; inducible promoters, such as the MMT promoter, the metallothionein promoter; heat shock promoters; the albumin promoter; the ApoAI promoter; human globin promoters; viral thymidine kinase promoters, such as the Herpes Simplex thymidine kinase promoter; retroviral LTRs; the b-actin promoter; and human growth hormone promoters. The promoter also may be the native promoter for the polynucleotide of the present invention.

Unlike other gene therapy techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct can be delivered to the interstitial space of tissues within the an animal, including of muscle, skin, brain, lung, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular, fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked nucleic acid sequence injection, an effective dosage amount of DNA or RNA will be in the range of from about 0.05 mg/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration.

The preferred route of administration is by the parenteral route of injection into the interstitial space of tissues. However, other parenteral routes may also be used, such as, inhalation of an aerosol formulation particularly for delivery to lungs or bronchial tissues, throat or mucous membranes of the nose. In addition, naked DNA constructs can be delivered to arteries during angioplasty by the catheter used in the procedure.

The naked polynucleotides are delivered by any method known in the art, including, but not limited to, direct needle injection at the delivery site, intravenous injection, topical administration, catheter infusion, and so-called "gene guns". These delivery methods are known in the art.

The constructs may also be delivered with delivery vehicles such as viral sequences, viral particles, liposome formulations, LIPOFECTIN™, precipitating agents, etc. Such methods of delivery are known in the art.

In certain embodiments, the polynucleotide constructs are complexed in a liposome preparation. Liposomal preparations for use in the instant invention include cationic (positively charged), anionic (negatively charged) and neutral preparations. However, cationic liposomes are particularly preferred because a tight charge complex can be formed between the cationic liposome and the polyanionic nucleic acid. Cationic liposomes have been shown to mediate intracellular delivery of plasmid DNA (Felgner et al., Proc. Natl. Acad. Sci. USA (1987) 84:7413-7416, which is herein incorporated by reference); mRNA (Malone et al., Proc. Natl. Acad. Sci. USA (1989) 86:6077-6081, which is herein incorporated by reference); and purified transcription factors (Debs et al., J. Biol. Chem. (1990) 265:10189-10192, which is herein incorporated by reference), in functional form.

Cationic liposomes are readily available. For example, N[1-2,3-dioleyloxy)propyl]-N,N,N-triethylammonium (DOTMA) liposomes are particularly useful and are available under the trademark LIPOFECTIN™, from GIBCO BRL, Grand Island, N.Y. (See, also, Felgner et al., Proc. Natl. Acad. Sci. USA (1987) 84:7413-7416, which is herein incorporated by reference). Other commercially available liposomes include transfectace (DDAB/DOPE) and DOTAP/DOPE (Boehringer).

Other cationic liposomes can be prepared from readily available materials using techniques well known in the art. See, e.g. PCT Publication No. WO 90/11092 (which is herein incorporated by reference) for a description of the synthesis of DOTAP (1,2-bis(oleoyloxy)-3-(trimethylammonio)propane) liposomes. Preparation of DOTMA liposomes is explained in the literature, see, e.g., P. Felgner et al., Proc. Natl. Acad. Sci. USA 84:7413-7417, which is herein incorporated by reference. Similar methods can be used to prepare liposomes from other cationic lipid materials.

Similarly, anionic and neutral liposomes are readily available, such as from Avanti Polar Lipids (Birmingham, Ala.), or can be easily prepared using readily available materials. Such materials include phosphatidyl, choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

For example, commercially dioleoylphosphatidyl choline (DOPC), dioleoylphosphatidyl glycerol (DOPG), and dioleoylphosphatidyl ethanolamine (DOPE) can be used in various combinations to make conventional liposomes, with or without the addition of cholesterol. Thus, for example, DOPG/DOPC vesicles can be prepared by drying 50 mg each of DOPG and DOPC under a stream of nitrogen gas into a sonication vial. The sample is placed under a vacuum pump overnight and is hydrated the following day with deionized water. The sample is then sonicated for 2 hours in a capped vial, using a Heat Systems model 350 sonicator equipped with an inverted cup (bath type) probe at the maximum setting while the bath is circulated at 15EC. Alternatively, negatively charged vesicles can be prepared without sonication to produce multilamellar vesicles or by extrusion through nucleopore membranes to produce unilamellar vesicles of discrete size. Other methods are known and available to those of skill in the art.

The liposomes can comprise multilamellar vesicles (MLVs), small unilamellar vesicles (SUVs), or large unilamellar vesicles (LUVs), with SUVs being preferred. The various liposome-nucleic acid complexes are prepared using methods well known in the art. See, e.g., Straubinger et al., Methods of Immunology (1983), 101:512-527, which is herein incorporated by reference. For example, MLVs containing nucleic acid can be prepared by depositing a thin film of phospholipid on the walls of a glass tube and subsequently hydrating with a solution of the material to be encapsulated. SUVs are prepared by extended sonication of MLVs to produce a homogeneous population of unilamellar liposomes. The material to be entrapped is added to a suspension of preformed MLVs and then sonicated. When using liposomes containing cationic lipids, the dried lipid film is resuspended in an appropriate solution such as sterile water or an isotonic buffer solution such as 10 mM Tris/NaCl, sonicated, and then the preformed liposomes are mixed directly with the DNA. The liposome and DNA form a very stable complex due to binding of the positively charged liposomes to the cationic DNA. SUVs find use with small nucleic acid fragments. LUVs are prepared by a number of methods, well known in the art. Commonly used methods include $Ca^{2+}$-EDTA chelation (Papahadjopoulos et al., Biochim. Biophys. Acta (1975) 394:483; Wilson et al., Cell 17:77 (1979)); ether injection (Deamer, D. and Bangham, A., Biochim. Biophys. Acta 443: 629 (1976); Ostro et al., Biochem. Biophys. Res. Commun. 76:836 (1977); Fraley et al., Proc. Natl. Acad. Sci. USA 76:3348 (1979)); detergent dialysis (Enoch, H. and Strittmatter, P., Proc. Natl. Acad. Sci. USA 76:145 (1979)); and reverse-phase evaporation (REV) (Fraley et al., J. Biol. Chem. 255:10431 (1980); Szoka, F. and Papahadjopoulos, D., Proc. Natl. Acad. Sci. USA 75:145 (1978); Schaefer-Ridder et al., Science 215:166 (1982)), which are herein incorporated by reference.

Generally, the ratio of DNA to liposomes will be from about 10:1 to about 1:10. Preferably, the ration will be from about 5:1 to about 1:5. More preferably, the ration will be about 3:1 to about 1:3. Still more preferably, the ratio will be about 1:1.

U.S. Pat. No. 5,676,954 (which is herein incorporated by reference) reports on the injection of genetic material, complexed with cationic liposomes carriers, into mice. U.S. Pat. Nos. 4,897,355, 4,946,787, 5,049,386, 5,459,127, 5,589,466, 5,693,622, 5,580,859, 5,703,055, and international publication no. WO 94/9469 (which are herein incorporated by reference) provide cationic lipids for use in transfecting DNA into cells and mammals. U.S. Pat. Nos. 5,589,466, 5,693,622, 5,580,859, 5,703,055, and international publication no. WO 94/9469 provide methods for delivering DNA-cationic lipid complexes to mammals.

In certain embodiments, cells are engineered, ex vivo or in vivo, using a retroviral particle containing RNA which comprises a sequence encoding a polypeptide of the present invention. Retroviruses from which the retroviral plasmid vectors may be derived include, but are not limited to, Moloney Murine Leukemia Virus, spleen necrosis virus, Rous sarcoma Virus, Harvey Sarcoma Virus, avian leukosis virus, gibbon ape leukemia virus, human immunodeficiency virus, Myeloproliferative Sarcoma Virus, and mammary tumor virus.

The retroviral plasmid vector is employed to transduce packaging cell lines to form producer cell lines. Examples of packaging cells which may be transfected include, but are not limited to, the PE501, PA317, R-2, R-AM, PA12, T19-14X, VT-19-17-H2, RCRE, RCRIP, GP+E-86, GP+envAm12, and DAN cell lines as described in Miller, Human Gene Therapy 1:5-14 (1990), which is incorporated herein by reference in its entirety. The vector may transduce the packaging cells through any means known in the art. Such means include, but are not limited to, electroporation, the use of liposomes, and $CaPO_4$ precipitation. In one alternative, the retroviral plasmid vector may be encapsulated into a liposome, or coupled to a lipid, and then administered to a host.

The producer cell line generates infectious retroviral vector particles which include polynucleotide encoding a polypeptide of the present invention. Such retroviral vector particles then may be employed, to transduce eukaryotic cells, either in vitro or in vivo. The transduced eukaryotic cells will express a polypeptide of the present invention.

In certain other embodiments, cells are engineered, ex vivo or in vivo, with polynucleotide contained in an adenovirus vector. Adenovirus can be manipulated such that it encodes and expresses a polypeptide of the present invention, and at the same time is inactivated in terms of its ability to replicate in a normal lytic viral life cycle. Adenovirus expression is achieved without integration of the viral DNA into the host cell chromosome, thereby alleviating concerns about insertional mutagenesis. Furthermore, adenoviruses have been used as live enteric vaccines for many years with an excellent safety profile (Schwartz et al. Am. Rev. Respir. Dis. 109:233-238 (1974)). Finally, adenovirus mediated gene transfer has been demonstrated in a number of instances including transfer of alpha-1-antitrypsin and CFTR to the lungs of cotton rats (Rosenfeld, M. A. et al. (1991) Science 252:431-434; Rosenfeld et al., (1992) Cell 68:143-155). Furthermore, extensive studies to attempt to establish adenovirus as a causative agent in human cancer were uniformly negative (Green, M. et al. (1979) Proc. Natl. Acad. Sci. USA 76:6606).

Suitable adenoviral vectors useful in the present invention are described, for example, in Kozarsky and Wilson, Curr. Opin. Genet. Devel. 3:499-503 (1993); Rosenfeld et al., Cell 68:143-155 (1992); Engelhardt et al., Human Genet. Ther. 4:759-769 (1993); Yang et al., Nature Genet. 7:362-369 (1994); Wilson et al., Nature 365:691-692 (1993); and U.S. Pat. No. 5,652,224, which are herein incorporated by reference. For example, the adenovirus vector Ad2 is useful and can be grown in human 293 cells. These cells contain the E1 region of adenovirus and constitutively express E1a and E1b, which complement the defective adenoviruses by providing the products of the genes deleted from the vector. In addition to Ad2, other varieties of adenovirus (e.g., Ad3, Ad5, and Ad7) are also useful in the present invention.

Preferably, the adenoviruses used in the present invention are replication deficient. Replication deficient adenoviruses require the aid of a helper virus and/or packaging cell line to form infectious particles. The resulting virus is capable of infecting cells and can express a polynucleotide of interest which is operably linked to a promoter, but cannot replicate in most cells. Replication deficient adenoviruses may be deleted in one or more of all or a portion of the following genes: E1a, E1b, E3, E4, E2a, or L1 through L5.

In certain other embodiments, the cells are engineered, ex vivo or in vivo, using an adeno-associated virus (AAV). AAVs are naturally occurring defective viruses that require helper viruses to produce infectious particles (Muzyczka, N., Curr. Topics in Microbiol. Immunol. 158:97 (1992)). It is also one of the few viruses that may integrate its DNA into non-dividing cells. Vectors containing as little as 300 base pairs of AAV can be packaged and can integrate, but space for exogenous DNA is limited to about 4.5 kb. Methods for producing and using such AAVs are known in the art. See, for example, U.S. Pat. Nos. 5,139,941, 5,173,414, 5,354,678, 5,436,146, 5,474,935, 5,478,745, and 5,589,377.

For example, an appropriate AAV vector for use in the present invention will include all the sequences necessary for DNA replication, encapsidation, and host-cell integration. The polynucleotide construct is inserted into the AAV vector using standard cloning methods, such as those found in Sambrook et al., Molecular Cloning: A Laboratory Manual, Cold Spring Harbor Press (1989). The recombinant AAV vector is then transfected into packaging cells which are infected with a helper virus, using any standard technique, including lipofection, electroporation, calcium phosphate precipitation, etc. Appropriate helper viruses include adenoviruses, cytomegaloviruses, vaccinia viruses, or herpes viruses. Once the packaging cells are transfected and infected, they will produce infectious AAV viral particles which contain the polynucleotide construct. These viral particles are then used to transduce eukaryotic cells, either ex vivo or in vivo. The transduced cells will contain the polynucleotide construct integrated into its genome, and will express a polypeptide of the invention.

Another method of gene therapy involves operably associating heterologous control regions and endogenous polynucleotide sequences (e.g. encoding a polypeptide of the present invention) via homologous recombination (see, e.g., U.S. Pat. No. 5,641,670, issued Jun. 24, 1997; International Publication No. WO 96/29411, published Sep. 26, 1996; International Publication No. WO 94/12650, published Aug. 4, 1994; Koller et al., Proc. Natl. Acad. Sci. USA 86:8932-8935 (1989); and Zijlstra et al., Nature 342:435-438 (1989), which are herein encorporated by reference. This method involves the activation of a gene which is present in the target cells, but which is not normally expressed in the cells, or is expressed at a lower level than desired.

Polynucleotide constructs are made, using standard techniques known in the art, which contain the promoter with targeting sequences flanking the promoter. Suitable promoters are described herein. The targeting sequence is sufficiently complementary to an endogenous sequence to permit homologous recombination of the promoter-targeting sequence with the endogenous sequence. The targeting sequence will be sufficiently near the 5' end of the desired endogenous polynucleotide sequence so the promoter will be operably linked to the endogenous sequence upon homologous recombination.

The promoter and the targeting sequences can be amplified using PCR. Preferably, the amplified promoter contains distinct restriction enzyme sites on the 5' and 3' ends. Preferably, the 3' end of the first targeting sequence contains the same restriction enzyme site as the 5' end of the amplified promoter and the 5' end of the second targeting sequence contains the same restriction site as the 3' end of the amplified promoter. The amplified promoter and targeting sequences are digested and ligated together.

The promoter-targeting sequence construct is delivered to the cells, either as naked polynucleotide, or in conjunction with transfection-facilitating agents, such as liposomes, viral sequences, viral particles, whole viruses, lipofection, precipitating agents, etc., described in more detail above. The P promoter-targeting sequence can be delivered by any method, included direct needle injection, intravenous injection, topical administration, catheter infusion, particle accelerators, etc. The methods are described in more detail below.

The promoter-targeting sequence construct is taken up by cells. Homologous recombination between the construct and the endogenous sequence takes place, such that an endogenous sequence is placed under the control of the promoter. The promoter then drives the expression of the endogenous sequence.

The polynucleotide encoding a polypeptide of the present invention may contain a secretory signal sequence that facilitates secretion of the protein. Typically, the signal sequence is positioned in the coding region of the polynucleotide to be expressed towards or at the 5' enc of the coding region. The signal sequence may be homologous or heterologous to the polynucleotide of interest and may be homologous or heterologous to the cells to be transfected. Additionally, the signal sequence may be chemically synthesized using methods known in the art.

Any mode of administration of any of the above-described polynucleotides constructs can be used so long as the mode results in the expression of one or more molecules in an amount sufficient to provide a therapeutic effect. This includes direct needle injection, systemic injection, catheter infusion, biolistic injectors, particle accelerators (i.e., "gene guns"), gelfoam sponge depots, other commercially available depot materials, osmotic pumps (e.g., Alza minipumps), oral or suppositorial solid (tablet or pill) pharmaceutical formulations, and decanting or topical applications during surgery. For example, direct injection of naked calcium phosphate-precipitated plasmid into rat liver and rat spleen or a protein-coated plasmid into the portal vein has resulted in gene expression of the foreign gene in the rat livers (Kaneda et al., Science 243:375 (1989)).

A preferred method of local administration is by direct injection. Preferably, a recombinant molecule of the present invention complexed with a delivery vehicle is administered by direct injection into or locally within the area of arteries. Administration of a composition locally within the area of arteries refers to injecting the composition centimeters and preferably, millimeters within arteries.

Another method of local administration is to contact a polynucleotide construct of the present invention in or around a surgical wound. For example, a patient can undergo surgery and the polynucleotide construct can be coated on the surface of tissue inside the wound or the construct can be injected into areas of tissue inside the wound.

Therapeutic compositions useful in systemic administration, include recombinant molecules of the present invention complexed to a targeted delivery vehicle of the present invention. Suitable delivery vehicles for use with systemic administration comprise liposomes comprising ligands for targeting the vehicle to a particular site. In specific embodiments, suitable delivery vehicles for use with systemic administration comprise liposomes comprising polypeptides of the invention for targeting the vehicle to a particular site.

Preferred methods of systemic administration, include intravenous injection, aerosol, oral and percutaneous (topical) delivery. Intravenous injections can be performed using methods standard in the art. Aerosol delivery can also be performed using methods standard in the art (see, for example, Stribling et al., Proc. Natl. Acad. Sci. USA 189: 11277-11281, 1992, which is incorporated herein by reference). Oral delivery can be performed by complexing a polynucleotide construct of the present invention to a carrier capable of withstanding degradation by digestive enzymes in the gut of an animal. Examples of such carriers, include plastic capsules or tablets, such as those known in the art. Topical delivery can be performed by mixing a polynucleotide construct of the present invention with a lipophilic reagent (e.g., DMSO) that is capable of passing into the skin.

Determining an effective amount of substance to be delivered can depend upon a number of factors including, for example, the chemical structure and biological activity of the substance, the age and weight of the animal, the precise condition requiring treatment and its severity, and the route of administration. The frequency of treatments depends upon a number of factors, such as the amount of polynucleotide constructs administered per dose, as well as the health and history of the subject. The precise amount, number of doses, and timing of doses will be determined by the attending physician or veterinarian.

Therapeutic compositions of the present invention can be administered to any animal, preferably to mammals and birds. Preferred mammals include humans, dogs, cats, mice, rats, rabbits sheep, cattle, horses and pigs, with humans being particularly preferred.

Biological Activities

Polynucleotides or polypeptides, or agonists or antagonists of the present invention, can be used in assays to test for one or more biological activities. If these polynucleotides or polypeptides, or agonists or antagonists of the present invention, do exhibit activity in a particular assay, it is likely that these molecules may be involved in the diseases associated with the biological activity. Thus, the polynucleotides and polypeptides, and agonists or antagonists could be used to treat the associated disease.

Members of the secreted family of proteins are believed to be involved in biological activities associated with, for example, cellular signaling. Accordingly, compositions of the invention (including polynucleotides, polypeptides and antibodies of the invention, and fragments and variants thereof) may be used in diagnosis, prognosis, prevention and/or treatment of diseases and/or disorders associated with aberrant activity of secreted polypeptides.

In preferred embodiments, compositions of the invention (including polynucleotides, polypeptides and antibodies of the invention, and fragments and variants thereof) may be used in the diagnosis, prognosis, prevention and/or treatment of diseases and/or disorders relating to diseases and disorders of the endocrine system, the nervous system (See, for example, "Neurological Disorders" section below), and the immune system (See, for example, "Immune Activity" section below).

In certain embodiments, a polypeptide of the invention, or polynucleotides, antibodies, agonists, or antagonists corresponding to that polypeptide, may be used to diagnose and/or prognose diseases and/or disorders associated with the tissue(s) in which the polypeptide of the invention is expressed including one, two, three, four, five, or more tissues disclosed in Table 1B.2, column 5 (Tissue Distribution Library Code).

Thus, polynucleotides, translation products and antibodies of the invention are useful in the diagnosis, detection and/or treatment of diseases and/or disorders associated with activities that include, but are not limited to, prohormone activation, neurotransmitter activity, cellular signaling, cellular proliferation, cellular differentiation, and cell migration.

More generally, polynucleotides, translation products and antibodies corresponding to this gene may be useful for the diagnosis, prognosis, prevention and/or treatment of diseases and/or disorders associated with the following systems.

Immune Activity

Polynucleotides, polypeptides, antibodies, and/or agonists or antagonists of the present invention may be useful in treating, preventing, diagnosing and/or prognosing diseases, disorders, and/or conditions of the immune system, by, for example, activating or inhibiting the proliferation, differentiation, or mobilization (chemotaxis) of immune cells. Immune cells develop through a process called hematopoiesis, producing myeloid (platelets, red blood cells, neutrophils, and macrophages) and lymphoid (B and T lymphocytes) cells from pluripotent stem cells. The etiology of these immune diseases, disorders, and/or conditions may be genetic, somatic, such as cancer and some autoimmune diseases, acquired (e.g., by chemotherapy or toxins), or infectious. Moreover, polynucleotides, polypeptides, antibodies, and/or agonists or antagonists of the present invention can be used as a marker or detector of a particular immune system disease or disorder.

In another embodiment, a polypeptide of the invention, or polynucleotides, antibodies, agonists, or antagonists corresponding to that polypeptide, may be used to treat diseases and disorders of the immune system and/or to inhibit or enhance an immune response generated by cells associated with the tissue(s) in which the polypeptide of the invention is expressed, including one, two, three, four, five, or more tissues disclosed in Table 1B.2, column 5 (Tissue Distribution Library Code).

Polynucleotides, polypeptides, antibodies, and/or agonists or antagonists of the present invention may be useful in treating, preventing, diagnosing, and/or prognosing immunodeficiencies, including both congenital and acquired immunodeficiencies. Examples of B cell immunodeficiencies in which immunoglobulin levels B cell function and/or B cell numbers are decreased include: X-linked agammaglobulinemia (Bruton's disease), X-linked infantile agammaglobulinemia, X-linked immunodeficiency with hyper IgM, non X-linked immunodeficiency with hyper IgM, X-linked lymphoproliferative syndrome (XLP), agammaglobulinemia including congenital and acquired agammaglobulinemia, adult onset agammaglobulinemia, late-onset agammaglobulinemia, dysgammaglobulinemia, hypogammaglobulinemia, unspecified hypogammaglobulinemia, recessive agammaglobulinemia (Swiss type), Selective IgM deficiency, selective IgA deficiency, selective IgG subclass deficiencies, IgG subclass deficiency (with or without IgA deficiency), Ig deficiency with increased IgM, IgG and IgA deficiency with increased IgM, antibody deficiency with normal or elevated Igs, Ig heavy chain deletions, kappa chain deficiency, B cell lymphoproliferative disorder (BLPD), common variable immunodeficiency (CVID), common variable immunodeficiency (CVI) (acquired), and transient hypogammaglobulinemia of infancy.

In specific embodiments, ataxia-telangiectasia or conditions associated with ataxia-telangiectasia are treated, prevented, diagnosed, and/or prognosing using the polypeptides or polynucleotides of the invention, and/or agonists or antagonists thereof.

Examples of congenital immunodeficiencies in which T cell and/or B cell function and/or number is decreased include, but are not limited to: DiGeorge anomaly, severe combined immunodeficiencies (SCID) (including, but not limited to, X-linked SCID, autosomal recessive SCID, adenosine deaminase deficiency, purine nucleoside phosphorylase (PNP) deficiency, Class II MHC deficiency (Bare lymphocyte syndrome), Wiskott-Aldrich syndrome, and ataxia telangiectasia), thymic hypoplasia, third and fourth pharyngeal pouch syndrome, 22q11.2 deletion, chronic mucocutaneous candidiasis, natural killer cell deficiency (NK), idiopathic CD4+ T-lymphocytopenia, immunodeficiency with predominant T cell defect (unspecified), and unspecified immunodeficiency of cell mediated immunity.

In specific embodiments, DiGeorge anomaly or conditions associated with DiGeorge anomaly are treated, prevented, diagnosed, and/or prognosed using polypeptides or polynucleotides of the invention, or antagonists or agonists thereof.

Other immunodeficiencies that may be treated, prevented, diagnosed, and/or prognosed using polypeptides or polynucleotides of the invention, and/or agonists or antagonists thereof, include, but are not limited to, chronic granulomatous disease, Chediak-Higashi syndrome, myeloperoxidase deficiency, leukocyte glucose-6-phosphate dehydrogenase deficiency, X-linked lymphoproliferative syndrome (XLP), leukocyte adhesion deficiency, complement component deficiencies (including C1, C2, C3, C4, C5, C6, C7, C8 and/or C9 deficiencies), reticular dysgenesis, thymic alymphoplasia-aplasia, immunodeficiency with thymoma, severe congenital leukopenia, dysplasia with immunodeficiency, neonatal neutropenia, short limbed dwarfism, and Nezelof syndrome-combined immunodeficiency with Igs.

In a preferred embodiment, the immunodeficiencies and/or conditions associated with the immunodeficiencies recited above are treated, prevented, diagnosed and/or prognosed using polynucleotides, polypeptides, antibodies, and/or agonists or antagonists of the present invention.

In a preferred embodiment polynucleotides, polypeptides, antibodies, and/or agonists or antagonists of the present invention could be used as an agent to boost immunoresponsiveness among immunodeficient individuals. In specific embodiments, polynucleotides, polypeptides, antibodies, and/or agonists or antagonists of the present invention could be used as an agent to boost immunoresponsiveness among B cell and/or T cell immunodeficient individuals.

The polynucleotides, polypeptides, antibodies, and/or agonists or antagonists of the present invention may be useful in treating, preventing, diagnosing and/or prognosing autoimmune disorders. Many autoimmune disorders result from inappropriate recognition of self as foreign material by immune cells. This inappropriate recognition results in an immune response leading to the destruction of the host tissue. Therefore, the administration of polynucleotides and polypeptides of the invention that can inhibit an immune response, particularly the proliferation, differentiation, or chemotaxis of T-cells, may be an effective therapy in preventing autoimmune disorders.

Autoimmune diseases or disorders that may be treated, prevented, diagnosed and/or prognosed by polynucleotides, polypeptides, antibodies, and/or agonists or antagonists of the present invention include, but are not limited to, one or more of the following: systemic lupus erythematosus, rheumatoid arthritis, ankylosing spondylitis, multiple sclerosis, autoimmune thyroiditis, Hashimoto's thyroiditis, autoimmune hemolytic anemia, hemolytic anemia, thrombocytopenia, autoimmune thrombocytopenia purpura, autoimmune neonatal thrombocytopenia, idiopathic thrombocytopenia purpura, purpura (e.g., Henloch-Scoenlein purpura), autoimmunocytopenia, Goodpasture's syndrome, Pemphigus vulgaris, myasthenia gravis, Grave's disease (hyperthyroidism), and insulin-resistant diabetes mellitus.

Additional disorders that are likely to have an autoimmune component that may be treated, prevented, and/or diagnosed with the compositions of the invention include, but are not limited to, type II collagen-induced arthritis, antiphospholipid syndrome, dermatitis, allergic encephalomyelitis, myocarditis, relapsing polychondritis, rheumatic heart disease, neuritis, uveitis ophthalmia, polyendocrinopathies, Reiter's Disease, Stiff-Man Syndrome, autoimmune pulmonary inflammation, autism, Guillain-Barre Syndrome, insulin dependent diabetes mellitus, and autoimmune inflammatory eye disorders.

Additional disorders that are likely to have an autoimmune component that may be treated, prevented, diagnosed and/or prognosed with the compositions of the invention include, but are not limited to, scleroderma with anti-collagen antibodies (often characterized, e.g., by nucleolar and other nuclear antibodies), mixed connective tissue disease (often characterized, e.g., by antibodies to extractable nuclear antigens (e.g., ribonucleoprotein)), polymyositis (often characterized, e.g., by nonhistone ANA), pernicious anemia (often characterized, e.g., by antiparietal cell, microsomes, and intrinsic factor antibodies), idiopathic Addison's disease (often characterized, e.g., by humoral and cell-mediated adrenal cytotoxicity, infertility (often characterized, e.g., by antispermatozoal antibodies), glomerulonephritis (often characterized, e.g., by glomerular basement membrane antibodies or immune complexes), bullous pemphigoid (often characterized, e.g., by IgG and complement in basement membrane), Sjogren's syndrome (often characterized, e.g., by multiple tissue antibodies, and/or a specific nonhistone ANA (SS-B)), diabetes mellitus (often characterized, e.g., by cell-mediated and humoral islet cell antibodies), and adrenergic drug resistance (including adrenergic drug resistance with asthma or cystic fibrosis) (often characterized, e.g., by beta-adrenergic receptor antibodies).

Additional disorders that may have an autoimmune component that may be treated, prevented, diagnosed and/or prognosed with the compositions of the invention include, but are not limited to, chronic active hepatitis (often characterized, e.g., by smooth muscle antibodies), primary biliary cirrhosis (often characterized, e.g., by mitochondria antibodies), other endocrine gland failure (often characterized, e.g., by specific tissue antibodies in some cases), vitiligo (often characterized, e.g., by melanocyte antibodies), vasculitis (often characterized, e.g., by Ig and complement in vessel walls and/or low serum complement), post-MI (often characterized, e.g., by myocardial antibodies), cardiotomy syndrome (often characterized, e.g., by myocardial antibodies), urticaria (often characterized, e.g., by IgG and IgM antibodies to IgE), atopic dermatitis (often characterized, e.g., by IgG and IgM antibodies to IgE), asthma (often characterized, e.g., by IgG and IgM antibodies to IgE), and many other inflammatory, granulomatous, degenerative, and atrophic disorders.

In a preferred embodiment, the autoimmune diseases and disorders and/or conditions associated with the diseases and disorders recited above are treated, prevented, diagnosed and/or prognosed using for example, antagonists or agonists, polypeptides or polynucleotides, or antibodies of the present invention. In a specific preferred embodiment, rheumatoid arthritis is treated, prevented, and/or diagnosed using polynucleotides, polypeptides, antibodies, and/or agonists or antagonists of the present invention.

In another specific preferred embodiment, systemic lupus erythematosus is treated, prevented, and/or diagnosed using polynucleotides, polypeptides, antibodies, and/or agonists or antagonists of the present invention. In another specific preferred embodiment, idiopathic thrombocytopenia purpura is treated, prevented, and/or diagnosed using polynucleotides, polypeptides, antibodies, and/or agonists or antagonists of the present invention.

In another specific preferred embodiment IgA nephropathy is treated, prevented, and/or diagnosed using polynucleotides, polypeptides, antibodies, and/or agonists or antagonists of the present invention.

In a preferred embodiment, the autoimmune diseases and disorders and/or conditions associated with the diseases and disorders recited above are treated, prevented, diagnosed and/or prognosed using polynucleotides, polypeptides, antibodies, and/or agonists or antagonists of the present invention In preferred embodiments, polypeptides, antibodies, polynucleotides and/or agonists or antagonists of the present invention are used as a immunosuppressive agent(s).

Polynucleotides, polypeptides, antibodies, and/or agonists or antagonists of the present invention may be useful in treating, preventing, prognosing, and/or diagnosing diseases, disorders, and/or conditions of hematopoietic cells. Polynucleotides, polypeptides, antibodies, and/or agonists or antagonists of the present invention could be used to increase differentiation and proliferation of hematopoietic cells, including the pluripotent stem cells, in an effort to treat or prevent those diseases, disorders, and/or conditions associated with a decrease in certain (or many) types hematopoietic cells, including but not limited to, leukopenia, neutropenia, anemia, and thrombocytopenia. Alternatively, Polynucleotides, polypeptides, antibodies, and/or agonists or antagonists of the present invention could be used to increase differentiation and proliferation of hematopoietic cells, including the pluripotent stem cells, in an effort to treat or prevent those diseases, disorders, and/or conditions associated with an increase in certain (or many) types of hematopoietic cells, including but not limited to, histiocytosis.

Allergic reactions and conditions, such as asthma (particularly allergic asthma) or other respiratory problems, may also be treated, prevented, diagnosed and/or prognosed using polypeptides, antibodies, or polynucleotides of the invention, and/or agonists or antagonists thereof. Moreover, these molecules can be used to treat, prevent, prognose, and/or diagnose anaphylaxis, hypersensitivity to an antigenic molecule, or blood group incompatibility.

Additionally, polypeptides or polynucleotides of the invention, and/or agonists or antagonists thereof, may be used to treat, prevent, diagnose and/or prognose IgE-mediated allergic reactions. Such allergic reactions include, but are not limited to, asthma, rhinitis, and eczema. In specific embodiments, polynucleotides, polypeptides, antibodies, and/or agonists or antagonists of the present invention may be used to modulate IgE concentrations in vitro or in vivo.

Moreover, polynucleotides, polypeptides, antibodies, and/or agonists or antagonists of the present invention have uses in the diagnosis, prognosis, prevention, and/or treatment of inflammatory conditions. For example, since polypeptides, antibodies, or polynucleotides of the invention, and/or agonists or antagonists of the invention may inhibit the activation, proliferation and/or differentiation of cells involved in an inflammatory response, these molecules can be used to prevent and/or treat chronic and acute inflammatory conditions. Such inflammatory conditions include, but are not limited to, for example, inflammation associated with infection (e.g., septic shock, sepsis, or systemic inflammatory response syndrome), ischemia-reperfusion injury, endotoxin lethality, complement-mediated hyperacute rejection, nephritis, cytokine or chemokine induced lung injury, inflammatory bowel disease, Crohn's disease, over production of cytokines (e.g., TNF or IL-1.), respiratory disorders (e.g., asthma and allergy); gastrointestinal disorders (e.g., inflammatory bowel disease); cancers (e.g., gastric, ovarian, lung, bladder, liver, and breast); CNS disorders (e.g., multiple sclerosis; ischemic brain injury and/or stroke, traumatic brain injury, neurodegenerative disorders (e.g., Parkinson's disease and Alzheimer's disease); AIDS-related dementia; and prion disease); cardiovascular disorders (e.g., atherosclerosis, myocarditis, cardiovascular disease, and cardiopulmonary bypass complications); as well as many additional diseases, conditions, and disorders that are characterized by inflammation (e.g., hepatitis, rheumatoid arthritis, gout, trauma, pancreatitis, sarcoidosis, dermatitis, renal ischemia-reperfusion injury, Grave's disease, systemic lupus erythematosus, diabetes mellitus, and allogenic transplant rejection).

Because inflammation is a fundamental defense mechanism, inflammatory disorders can effect virtually any tissue of the body. Accordingly, polynucleotides, polypeptides, and antibodies of the invention, as well as agonists or antagonists thereof, have uses in the treatment of tissue-specific inflammatory disorders, including, but not limited to, adrenalitis, alveolitis, angiocholecystitis, appendicitis, balanitis, blepharitis, bronchitis, bursitis, carditis, cellulitis, cervicitis, cholecystitis, chorditis, cochlitis, colitis, conjunctivitis, cystitis, dermatitis, diverticulitis, encephalitis, endocarditis, esophagitis, eustachitis, fibrositis, folliculitis, gastritis, gastroenteritis, gingivitis, glossitis, hepatosplenitis, keratitis, labyrinthitis, laryngitis, lymphangitis, mastitis, media otitis, meningitis, metritis, mucitis, myocarditis, myositis, myringitis, nephritis, neuritis, orchitis, osteochondritis, otitis, pericarditis, peritendonitis, peritonitis, pharyngitis, phlebitis, poliomyelitis, prostatitis, pulpitis, retinitis, rhinitis, salpingitis, scleritis, sclerochoroiditis, scrotitis, sinusitis, spondylitis, steatitis, stomatitis, synovitis, syringitis, tendonitis, tonsillitis, urethritis, and vaginitis.

In specific embodiments, polypeptides, antibodies, or polynucleotides of the invention, and/or agonists or antagonists thereof, are useful to diagnose, prognose, prevent, and/or treat organ transplant rejections and graft-versus-host disease. Organ rejection occurs by host immune cell destruction of the transplanted tissue through an immune response. Similarly, an immune response is also involved in GVHD, but, in this case, the foreign transplanted immune cells destroy the host tissues. Polypeptides, antibodies, or polynucleotides of the invention, and/or agonists or antagonists thereof, that inhibit an immune response, particularly the activation, proliferation, differentiation, or chemotaxis of T-cells, may be an effective therapy in preventing organ rejection or GVHD. In specific embodiments, polypeptides, antibodies, or polynucleotides of the invention, and/or agonists or antagonists thereof, that inhibit an immune response, particularly the activation, proliferation, differentiation, or chemotaxis of T-cells, may be an effective therapy in preventing experimental allergic and hyperacute xenograft rejection.

In other embodiments, polypeptides, antibodies, or polynucleotides of the invention, and/or agonists or antagonists thereof, are useful to diagnose, prognose, prevent, and/or treat immune complex diseases, including, but not limited to, serum sickness, post streptococcal glomerulonephritis, polyarteritis nodosa, and immune complex-induced vasculitis.

Polypeptides, antibodies, polynucleotides and/or agonists or antagonists of the invention can be used to treat, detect, and/or prevent infectious agents. For example, by increasing the immune response, particularly increasing the proliferation activation and/or differentiation of B and/or T cells, infectious diseases may be treated, detected, and/or prevented. The immune response may be increased by either enhancing an existing immune response, or by initiating a new immune response. Alternatively, polynucleotides, polypeptides, antibodies, and/or agonists or antagonists of the present invention may also directly inhibit the infectious agent (refer to section of application listing infectious agents, etc), without necessarily eliciting an immune response.

In another embodiment, polypeptides, antibodies, polynucleotides and/or agonists or antagonists of the present invention are used as a vaccine adjuvant that enhances immune responsiveness to an antigen. In a specific embodiment, polypeptides, antibodies, polynucleotides and/or agonists or antagonists of the present invention are used as an adjuvant to enhance tumor-specific immune responses.

In another specific embodiment, polypeptides, antibodies, polynucleotides and/or agonists or antagonists of the present invention are used as an adjuvant to enhance anti-viral immune responses. Anti-viral immune responses that may be enhanced using the compositions of the invention as an adjuvant, include virus and virus associated diseases or symptoms described herein or otherwise known in the art. In specific embodiments, the compositions of the invention are used as an adjuvant to enhance an immune response to a virus, disease, or symptom selected from the group consisting of: AIDS, meningitis, Dengue, EBV, and hepatitis (e.g., hepatitis B). In another specific embodiment, the compositions of the invention are used as an adjuvant to enhance an immune response to a virus, disease, or symptom selected from the group consisting of: HIV/AIDS, respiratory syncytial virus, Dengue, rotavirus, Japanese B encephalitis, influenza A and B, parainfluenza, measles, cytomegalovirus, rabies, Junin, Chikungunya, Rift Valley Fever, herpes simplex, and yellow fever.

In another specific embodiment, polypeptides, antibodies, polynucleotides and/or agonists or antagonists of the present invention are used as an adjuvant to enhance anti-bacterial or anti-fungal immune responses. Anti-bacterial or anti-fungal immune responses that may be enhanced using the compositions of the invention as an adjuvant, include bacteria or fungus and bacteria or fungus associated diseases or symptoms described herein or otherwise known in the art. In specific embodiments, the compositions of the invention are used as an adjuvant to enhance an immune response to a bacteria or fungus, disease, or symptom selected from the group consisting of: tetanus, Diphtheria, botulism, and meningitis type B. In another specific embodiment, the compositions of the invention are used as an adjuvant to enhance an immune response to a bacteria or fungus, disease, or symptom selected from the group consisting of: *Vibrio cholerae, Mycobacterium leprae, Salmonella typhi, Salmonella paratyphi, Meisseria meningitidis, Streptococcus pneumoniae*, Group B *streptococcus, Shigella* spp., Enterotoxigenic *Escherichia coli*, Enterohemorrhagic *E. coli*, and *Borrelia burgdorferi*.

In another specific embodiment, polypeptides, antibodies, polynucleotides and/or agonists or antagonists of the present invention are used as an adjuvant to enhance anti-parasitic immune responses. Anti-parasitic immune responses that may be enhanced using the compositions of the invention as an adjuvant, include parasite and parasite associated diseases or symptoms described herein or otherwise known in the art. In specific embodiments, the compositions of the invention are used as an adjuvant to enhance an immune response to a parasite. In another specific embodiment, the compositions of the invention are used as an adjuvant to enhance an immune response to *Plasmodium* (malaria) or *Leishmania*.

In another specific embodiment, polypeptides, antibodies, polynucleotides and/or agonists or antagonists of the present invention may also be employed to treat infectious diseases including silicosis, sarcoidosis, and idiopathic pulmonary fibrosis; for example, by preventing the recruitment and activation of mononuclear phagocytes.

In another specific embodiment, polypeptides, antibodies, polynucleotides and/or agonists or antagonists of the present invention are used as an antigen for the generation of antibodies to inhibit or enhance immune mediated responses against polypeptides of the invention.

In one embodiment, polypeptides, antibodies, polynucleotides and/or agonists or antagonists of the present invention are administered to an animal (e.g., mouse, rat, rabbit, hamster, guinea pig, pigs, micro-pig, chicken, camel, goat, horse, cow, sheep, dog, cat, non-human primate, and human, most preferably human) to boost the immune system to produce increased quantities of one or more antibodies (e.g., IgG, IgA, IgM, and IgE), to induce higher affinity antibody production and immunoglobulin class switching (e.g., IgG, IgA, IgM, and IgE), and/or to increase an immune response.

In another specific embodiment, polypeptides, antibodies, polynucleotides and/or agonists or antagonists of the present invention are used as a stimulator of B cell responsiveness to pathogens.

In another specific embodiment, polypeptides, antibodies, polynucleotides and/or agonists or antagonists of the present invention are used as an activator of T cells.

In another specific embodiment, polypeptides, antibodies, polynucleotides and/or agonists or antagonists of the present invention are used as an agent that elevates the immune status of an individual prior to their receipt of immunosuppressive therapies.

In another specific embodiment, polypeptides, antibodies, polynucleotides and/or agonists or antagonists of the present invention are used as an agent to induce higher affinity antibodies.

In another specific embodiment, polypeptides, antibodies, polynucleotides and/or agonists or antagonists of the present invention are used as an agent to increase serum immunoglobulin concentrations.

In another specific embodiment, polypeptides, antibodies, polynucleotides and/or agonists or antagonists of the present invention are used as an agent to accelerate recovery of immunocompromised individuals.

In another specific embodiment, polypeptides, antibodies, polynucleotides and/or agonists or antagonists of the present invention are used as an agent to boost immunoresponsiveness among aged populations and/or neonates.

In another specific embodiment, polypeptides, antibodies, polynucleotides and/or agonists or antagonists of the present invention are used as an immune system enhancer prior to, during, or after bone marrow transplant and/or other transplants (e.g., allogeneic or xenogeneic organ transplantation). With respect to transplantation, compositions of the invention may be administered prior to, concomitant with, and/or after transplantation. In a specific embodiment, compositions of the invention are administered after transplantation, prior to the beginning of recovery of T-cell populations. In another specific embodiment, compositions of the invention are first administered after transplantation after the beginning of recovery of T cell populations, but prior to full recovery of B cell populations.

In another specific embodiment, polypeptides, antibodies, polynucleotides and/or agonists or antagonists of the present invention are used as an agent to boost immunoresponsiveness among individuals having an acquired loss of B cell function. Conditions resulting in an acquired loss of B cell function that may be ameliorated or treated by administering the polypeptides, antibodies, polynucleotides and/or agonists or antagonists thereof, include, but are not limited to, HIV Infection, AIDS, bone marrow transplant, and B cell chronic lymphocytic leukemia (CLL).

In another specific embodiment, polypeptides, antibodies, polynucleotides and/or agonists or antagonists of the present invention are used as an agent to boost immunoresponsiveness among individuals having a temporary immune deficiency. Conditions resulting in a temporary immune deficiency that may be ameliorated or treated by administering the polypeptides, antibodies, polynucleotides and/or agonists or antagonists thereof, include, but are not limited to, recovery from viral infections (e.g., influenza), conditions associated with malnutrition, recovery from infectious mononucleosis, or conditions associated with stress, recovery from measles, recovery from blood transfusion, and recovery from surgery.

In another specific embodiment, polypeptides, antibodies, polynucleotides and/or agonists or antagonists of the present invention are used as a regulator of antigen presentation by monocytes, dendritic cells, and/or B-cells. In one embodiment, polynucleotides, polypeptides, antibodies, and/or agonists or antagonists of the present invention enhance antigen presentation or antagonizes antigen presentation in vitro or in vivo. Moreover, in related embodiments, said enhancement or antagonism of antigen presentation may be useful as an anti-tumor treatment or to modulate the immune system.

In another specific embodiment, polypeptides, antibodies, polynucleotides and/or agonists or antagonists of the present invention are used as an agent to direct an individual's immune system towards development of a humoral response (i.e. TH2) as opposed to a TH1 cellular response.

In another specific embodiment, polypeptides, antibodies, polynucleotides and/or agonists or antagonists of the present invention are used as a means to induce tumor proliferation and thus make it more susceptible to anti-neoplastic agents. For example, multiple myeloma is a slowly dividing disease and is thus refractory to virtually all anti-neoplastic regimens. If these cells were forced to proliferate more rapidly their susceptibility profile would likely change.

In another specific embodiment, polypeptides, antibodies, polynucleotides and/or agonists or antagonists of the present invention are used as a stimulator of B cell production in pathologies such as AIDS, chronic lymphocyte disorder and/or Common Variable Immunodificiency.

In another specific embodiment, polypeptides, antibodies, polynucleotides and/or agonists or antagonists of the present invention are used as a therapy for generation and/or regeneration of lymphoid tissues following surgery, trauma or genetic defect. In another specific embodiment, polypeptides, antibodies, polynucleotides and/or agonists or antagonists of the present invention are used in the pretreatment of bone marrow samples prior to transplant.

In another specific embodiment, polypeptides, antibodies, polynucleotides and/or agonists or antagonists of the present invention are used as a gene-based therapy for genetically inherited disorders resulting in immuno-incompetence/immunodeficiency such as observed among SCID patients.

In another specific embodiment, polypeptides, antibodies, polynucleotides and/or agonists or antagonists of the present invention are used as a means of activating monocytes/macrophages to defend against parasitic diseases that effect monocytes such as Leishmania.

In another specific embodiment, polypeptides, antibodies, polynucleotides and/or agonists or antagonists of the present invention are used as a means of regulating secreted cytokines that are elicited by polypeptides of the invention.

In another embodiment, polypeptides, antibodies, polynucleotides and/or agonists or antagonists of the present invention are used in one or more of the applications described herein, as they may apply to veterinary medicine.

In another specific embodiment, polypeptides, antibodies, polynucleotides and/or agonists or antagonists of the present invention are used as a means of blocking various aspects of immune responses to foreign agents or self. Examples of diseases or conditions in which blocking of certain aspects of immune responses may be desired include autoimmune disorders such as lupus, and arthritis, as well as immunoresponsiveness to skin allergies, inflammation, bowel disease, injury and diseases/disorders associated with pathogens.

In another specific embodiment, polypeptides, antibodies, polynucleotides and/or agonists or antagonists of the present invention are used as a therapy for preventing the B cell proliferation and Ig secretion associated with autoimmune diseases such as idiopathic thrombocytopenic purpura, systemic lupus erythematosus and multiple sclerosis.

In another specific embodiment, polypeptides, antibodies, polynucleotides and/or agonists or antagonists of the present invention are used as a inhibitor of B and/or T cell migration in endothelial cells. This activity disrupts tissue architecture or cognate responses and is useful, for example in disrupting immune responses, and blocking sepsis.

In another specific embodiment, polypeptides, antibodies, polynucleotides and/or agonists or antagonists of the present invention are used as a therapy for chronic hypergammaglobulinemia evident in such diseases as monoclonal gammopathy of undetermined significance (MGUS), Waldenstrom's disease, related idiopathic monoclonal gammopathies, and plasmacytomas.

In another specific embodiment, polypeptides, antibodies, polynucleotides and/or agonists or antagonists of the present invention may be employed for instance to inhibit polypeptide chemotaxis and activation of macrophages and their precursors, and of neutrophils, basophils, B lymphocytes and some T-cell subsets, e.g., activated and CD8 cytotoxic T cells and natural killer cells, in certain autoimmune and chronic inflammatory and infective diseases. Examples of autoimmune diseases are described herein and include multiple sclerosis, and insulin-dependent diabetes.

The polypeptides, antibodies, polynucleotides and/or agonists or antagonists of the present invention may also be employed to treat idiopathic hyper-eosinophilic syndrome by, for example, preventing eosinophil production and migration.

In another specific embodiment, polypeptides, antibodies, polynucleotides and/or agonists or antagonists of the present invention are used to enhance or inhibit complement mediated cell lysis.

In another specific embodiment, polypeptides, antibodies, polynucleotides and/or agonists or antagonists of the present invention are used to enhance or inhibit antibody dependent cellular cytotoxicity.

In another specific embodiment, polypeptides, antibodies, polynucleotides and/or agonists or antagonists of the present invention may also be employed for treating atherosclerosis, for example, by preventing monocyte infiltration in the artery wall.

In another specific embodiment, polypeptides, antibodies, polynucleotides and/or agonists or antagonists of the present invention may be employed to treat adult respiratory distress syndrome (ARDS).

In another specific embodiment, polypeptides, antibodies, polynucleotides and/or agonists or antagonists of the present invention may be useful for stimulating wound and tissue repair, stimulating angiogenesis, and/or stimulating the repair of vascular or lymphatic diseases or disorders. Additionally, agonists and antagonists of the invention may be used to stimulate the regeneration of mucosal surfaces.

In a specific embodiment, polynucleotides or polypeptides, and/or agonists thereof are used to diagnose, prognose, treat, and/or prevent a disorder characterized by primary or acquired immunodeficiency, deficient serum immunoglobulin production, recurrent infections, and/or immune system dysfunction. Moreover, polynucleotides or polypeptides, and/or agonists thereof may be used to treat or prevent infections of the joints, bones, skin, and/or parotid glands, blood-borne infections (e.g., sepsis, meningitis, septic arthritis, and/or osteomyelitis), autoimmune diseases (e.g., those disclosed herein), inflammatory disorders, and malignancies, and/or any disease or disorder or condition associated with these infections, diseases, disorders and/or malignancies) including, but not limited to, CVID, other primary immune deficiencies, HIV disease, CLL, recurrent bronchitis, sinusitis, otitis media, conjunctivitis, pneumonia, hepatitis, meningitis, herpes zoster (e.g., severe herpes zoster), and/or *pneumocystis carnii*. Other diseases and disorders that may be prevented, diagnosed, prognosed, and/or treated with polynucleotides or polypeptides, and/or agonists of the present invention include, but are not limited to, HIV infection, HTLV-BLV infection, lymphopenia, phagocyte bactericidal dysfunction anemia, thrombocytopenia, and hemoglobinuria.

In another embodiment, polynucleotides, polypeptides, antibodies, and/or agonists or antagonists of the present invention are used to treat, and/or diagnose an individual having common variable immunodeficiency disease ("CVID"; also known as "acquired agammaglobulinemia" and "acquired hypogammaglobulinemia") or a subset of this disease.

In a specific embodiment, polynucleotides, polypeptides, antibodies, and/or agonists or antagonists of the present invention may be used to diagnose, prognose, prevent, and/or treat cancers or neoplasms including immune cell or immune tissue-related cancers or neoplasms. Examples of cancers or neoplasms that may be prevented, diagnosed, or treated by polynucleotides, polypeptides, antibodies, and/or agonists or antagonists of the present invention include, but are not limited to, acute myelogenous leukemia, chronic myelogenous leukemia, Hodgkin's disease, non-Hodgkin's lymphoma, acute lymphocytic anemia (ALL) Chronic lymphocyte leukemia, plasmacytomas, multiple myeloma, Burkitt's lymphoma, EBV-transformed diseases, and/or diseases and disorders described in the section entitled "Hyperproliferative Disorders" elsewhere herein.

In another specific embodiment, polypeptides, antibodies, polynucleotides and/or agonists or antagonists of the present invention are used as a therapy for decreasing cellular proliferation of Large B-cell Lymphomas.

In another specific embodiment, polypeptides, antibodies, polynucleotides and/or agonists or antagonists of the present invention are used as a means of decreasing the involvement of B cells and Ig associated with Chronic Myelogenous Leukemia.

In specific embodiments, the compositions of the invention are used as an agent to boost immunoresponsiveness among B cell immunodeficient individuals, such as, for example, an individual who has undergone a partial or complete splenectomy.

Antagonists of the invention include, for example, binding and/or inhibitory antibodies, antisense nucleic acids, ribozymes or soluble forms of the polypeptides of the present invention (e.g., Fc fusion protein; see, e.g., Example 9). Agonists of the invention include, for example, binding or stimulatory antibodies, and soluble forms of the polypeptides (e.g., Fc fusion proteins; see, e.g., Example 9). polypeptides, antibodies, polynucleotides and/or agonists or antagonists of the present invention may be employed in a composition with a pharmaceutically acceptable carrier, e.g., as described herein.

In another embodiment, polypeptides, antibodies, polynucleotides and/or agonists or antagonists of the present invention are administered to an animal (including, but not limited to, those listed above, and also including transgenic animals) incapable of producing functional endogenous antibody molecules or having an otherwise compromised endogenous immune system, but which is capable of producing human immunoglobulin molecules by means of a reconstituted or partially reconstituted immune system from another animal (see, e.g., published PCT Application Nos. WO98/24893, WO/9634096, WO/9633735, and WO/9110741). Administration of polypeptides, antibodies, polynucleotides and/or agonists or antagonists of the present invention to such animals is useful for the generation of monoclonal antibodies against the polypeptides, antibodies, polynucleotides and/or agonists or antagonists of the present invention.

Blood-Related Disorders

The polynucleotides, polypeptides, antibodies, and/or agonists or antagonists of the present invention may be used to modulate hemostatic (the stopping of bleeding) or thrombolytic (clot dissolving) activity. For example, by increasing hemostatic or thrombolytic activity, polynucleotides or polypeptides, and/or agonists or antagonists of the present invention could be used to treat or prevent blood coagulation diseases, disorders, and/or conditions (e.g., afibrinogenemia, factor deficiencies, hemophilia), blood platelet diseases, disorders, and/or conditions (e.g., thrombocytopenia), or wounds resulting from trauma, surgery, or other causes. Alternatively, polynucleotides, polypeptides, antibodies, and/or agonists or antagonists of the present invention that can decrease hemostatic or thrombolytic activity could be used to inhibit or dissolve clotting. These molecules could be important in the treatment or prevention of heart attacks (infarction), strokes, or scarring.

In specific embodiments, the polynucleotides, polypeptides, antibodies, and/or agonists or antagonists of the present invention may be used to prevent, diagnose, prognose, and/or treat thrombosis, arterial thrombosis, venous thrombosis, thromboembolism, pulmonary embolism, atherosclerosis, myocardial infarction, transient ischemic attack, unstable angina. In specific embodiments, the polynucleotides, polypeptides, antibodies, and/or agonists or antagonists of the present invention may be used for the prevention of occlusion of saphenous grafts, for reducing the risk of periprocedural thrombosis as might accompany angioplasty procedures, for reducing the risk of stroke in patients with atrial fibrillation including nonrheumatic atrial fibrillation, for reducing the risk of embolism associated with mechanical heart valves and or mitral valves disease. Other uses for the polynucleotides, polypeptides, antibodies, and/or agonists or antagonists of the present invention, include, but are not limited to, the prevention of occlusions in extrcorporeal devices (e.g., intravascular canulas, vascular access shunts in hemodialysis patients, hemodialysis machines, and cardiopulmonary bypass machines).

In another embodiment, a polypeptide of the invention, or polynucleotides, antibodies, agonists, or antagonists corresponding to that polypeptide, may be used to prevent, diagnose, prognose, and/or treat diseases and disorders of the blood and/or blood forming organs associated with the tissue(s) in which the polypeptide of the invention is expressed, including one, two, three, four, five, or more tissues disclosed in Table 1B.2, column 5 (Tissue Distribution Library Code).

The polynucleotides, polypeptides, antibodies, and/or agonists or antagonists of the present invention may be used to modulate hematopoietic activity (the formation of blood cells). For example, the polynucleotides, polypeptides, antibodies, and/or agonists or antagonists of the present invention may be used to increase the quantity of all or subsets of blood cells, such as, for example, erythrocytes, lymphocytes (B or T cells), myeloid cells (e.g., basophils, eosinophils, neutrophils, mast cells, macrophages) and platelets. The ability to decrease the quantity of blood cells or subsets of blood cells may be useful in the prevention, detection, diagnosis and/or treatment of anemias and leukopenias described below. Alternatively, the polynucleotides, polypeptides, antibodies, and/or agonists or antagonists of the present invention may be used to decrease the quantity of all or subsets of blood cells, such as, for example, erythrocytes, lymphocytes (B or T cells), myeloid cells (e.g., basophils, eosinophils, neutrophils, mast cells, macrophages) and platelets. The ability to decrease the quantity of blood cells or subsets of blood cells may be useful in the prevention, detection, diagnosis and/or treatment of leukocytoses, such as, for example eosinophilia.

The polynucleotides, polypeptides, antibodies, and/or agonists or antagonists of the present invention may be used to prevent, treat, or diagnose blood dyscrasia.

Anemias are conditions in which the number of red blood cells or amount of hemoglobin (the protein that carries oxygen) in them is below normal. Anemia may be caused by excessive bleeding, decreased red blood cell production, or increased red blood cell destruction (hemolysis). The polynucleotides, polypeptides, antibodies, and/or agonists or antagonists of the present invention may be useful in treating, preventing, and/or diagnosing anemias. Anemias that may be treated prevented or diagnosed by the polynucleotides, polypeptides, antibodies, and/or agonists or antagonists of the present invention include iron deficiency anemia, hypochromic anemia, microcytic anemia, chlorosis, hereditary siderob; astic anemia, idiopathic acquired sideroblastic anemia, red cell aplasia, megaloblastic anemia (e.g., pernicious anemia, (vitamin B12 deficiency) and folic acid deficiency anemia), aplastic anemia, hemolytic anemias (e.g., autoimmune helolytic anemia, microangiopathic hemolytic anemia, and paroxysmal nocturnal hemoglobinuria). The polynucleotides, polypeptides, antibodies, and/or agonists or antagonists of the present invention may be useful in treating, preventing, and/or diagnosing anemias associated with diseases including but not limited to, anemias associated with systemic lupus erythematosus, cancers, lymphomas, chronic renal disease, and enlarged spleens. The polynucleotides, polypeptides, antibodies, and/or agonists or antagonists of the present invention may be useful in treating, preventing, and/or diagnosing anemias arising from drug treatments such as anemias associated with methyldopa, dapsone, and/or sulfadrugs. Additionally, the polynucleotides, polypeptides, antibodies, and/or agonists or antagonists of the present invention may be useful in treating, preventing, and/or diagnosing anemias associated with abnormal red blood cell architecture including but not limited to, hereditary spherocytosis, hereditary elliptocytosis, glucose-6-phosphate dehydrogenase deficiency, and sickle cell anemia.

The polynucleotides, polypeptides, antibodies, and/or agonists or antagonists of the present invention may be useful in treating, preventing, and/or diagnosing hemoglobin abnormalities, (e.g., those associated with sickle cell anemia, hemoglobin C disease, hemoglobin S-C disease, and hemoglobin E disease). Additionally, the polynucleotides, polypeptides, antibodies, and/or agonists or antagonists of the present invention may be useful in diagnosing, prognosing, preventing, and/or treating thalassemias, including, but not limited to major and minor forms of alpha-thalassemia and beta-thalassemia.

In another embodiment, the polynucleotides, polypeptides, antibodies, and/or agonists or antagonists of the present invention may be useful in diagnosing, prognosing, preventing, and/or treating bleeding disorders including, but not limited to, thrombocytopenia (e.g., idiopathic thrombocytopenic purpura, and thrombotic thrombocytopenic purpura), Von Willebrand's disease, hereditary platelet disorders (e.g., storage pool disease such as Chediak-Higashi and Hermansky-Pudlak syndromes, thromboxane A2 dysfunction, thromboasthenia, and Bernard-Soulier syndrome), hemolytic-uremic syndrome, hemophelias such as hemophelia A or Factor VII deficiency and Christmas disease or Factor IX deficiency, Hereditary Hemorhhagic Telangiectsia, also known as Rendu-Osler-Weber syndrome, allergic purpura (Henoch Schonlein purpura) and disseminated intravascular coagulation.

The effect of the polynucleotides, polypeptides, antibodies, and/or agonists or antagonists of the present invention on the clotting time of blood may be monitored using any of the clotting tests known in the art including, but not limited to, whole blood partial thromboplastin time (PTT), the activated partial thromboplastin time (aPTT), the activated clotting time (ACT), the recalcified activated clotting time, or the Lee-White Clotting time.

Several diseases and a variety of drugs can cause platelet dysfunction. Thus, in a specific embodiment, the polynucleotides, polypeptides, antibodies, and/or agonists or antagonists of the present invention may be useful in diagnosing, prognosing, preventing, and/or treating acquired platelet dysfunction such as platelet dysfunction accompanying kidney failure, leukemia, multiple myeloma, cirrhosis of the liver, and systemic lupus erythematosus as well as platelet dysfunction associated with drug treatments, including treatment with aspirin, ticlopidine, nonsteroidal anti-inflammatory drugs (used for arthritis, pain, and sprains), and penicillin in high doses.

In another embodiment, the polynucleotides, polypeptides, antibodies, and/or agonists or antagonists of the present invention may be useful in diagnosing, prognosing, preventing, and/or treating diseases and disorders characterized by or associated with increased or decreased numbers of white blood cells. Leukopenia occurs when the number of white blood cells decreases below normal. Leukopenias include, but are not limited to, neutropenia and lymphocytopenia. An increase in the number of white blood cells compared to normal is known as leukocytosis. The body generates increased numbers of white blood cells during infection. Thus, leukocytosis may simply be a normal physiological parameter that reflects infection. Alternatively, leukocytosis may be an indicator of injury or other disease such as cancer. Leokocytoses, include but are not limited to, eosinophilia, and accumulations of macrophages. In specific embodiments, the polynucleotides, polypeptides, antibodies, and/or agonists or antagonists of the present invention may be useful in diagnosing, prognosing, preventing, and/or treating leukopenia. In other specific embodiments, the polynucleotides, polypeptides, antibodies, and/or agonists or antagonists of the present invention may be useful in diagnosing, prognosing, preventing, and/or treating leukocytosis.

Leukopenia may be a generalized decreased in all types of white blood cells, or may be a specific depletion of particular types of white blood cells. Thus, in specific embodiments, the polynucleotides, polypeptides, antibodies, and/or agonists or antagonists of the present invention may be useful in diagnosing, prognosing, preventing, and/or treating decreases in neutrophil numbers, known as neutropenia. Neutropenias that may be diagnosed, prognosed, prevented, and/or treated by the polynucleotides, polypeptides, antibodies, and/or agonists or antagonists of the present invention include, but are not limited to, infantile genetic agranulocytosis, familial neutropenia, cyclic neutropenia, neutropenias resulting from or associated with dietary deficiencies (e.g., vitamin B 12 deficiency or folic acid deficiency), neutropenias resulting from or associated with drug treatments (e.g., antibiotic regimens such as penicillin treatment, sulfonamide treatment, anticoagulant treatment, anticonvulsant drugs, anti-thyroid drugs, and cancer chemotherapy), and neutropenias resulting from increased neutrophil destruction that may occur in association with some bacterial or viral infections, allergic disorders, autoimmune diseases, conditions in which an individual has an enlarged spleen (e.g., Felty syndrome, malaria and sarcoidosis), and some drug treatment regimens.

The polynucleotides, polypeptides, antibodies, and/or agonists or antagonists of the present invention may be useful in diagnosing, prognosing, preventing, and/or treating lymphocytopenias (decreased numbers of B and/or T lymphocytes), including, but not limited lymphocytopenias resulting from or associated with stress, drug treatments (e.g., drug treatment with corticosteroids, cancer chemotherapies, and/or radiation therapies), AIDS infection and/or other diseases such as, for example, cancer, rheumatoid arthritis, systemic lupus erythematosus, chronic infections, some viral infections and/or hereditary disorders (e.g., DiGeorge syndrome, Wiskott-Aldrich Syndrome, severe combined immunodeficiency, ataxia telangiectsia).

The polynucleotides, polypeptides, antibodies, and/or agonists or antagonists of the present invention may be useful in diagnosing, prognosing, preventing, and/or treating diseases and disorders associated with macrophage numbers and/or macrophage function including, but not limited to, Gaucher's disease, Niemann-Pick disease, Letterer-Siwe disease and Hand-Schuller-Christian disease.

In another embodiment, the polynucleotides, polypeptides, antibodies, and/or agonists or antagonists of the present invention may be useful in diagnosing, prognosing, preventing, and/or treating diseases and disorders associated with eosinophil numbers and/or eosinophil function including, but not limited to, idiopathic hypereosinophilic syndrome, eosinophilia-myalgia syndrome, and Hand-Schuller-Christian disease.

In yet another embodiment, the polynucleotides, polypeptides, antibodies, and/or agonists or antagonists of the present invention may be useful in diagnosing, prognosing, preventing, and/or treating leukemias and lymphomas including, but not limited to, acute lymphocytic (lymphpblastic) leukemia (ALL), acute myeloid (myelocytic, myelogenous, myeloblastic, or myelomonocytic) leukemia, chronic lymphocytic leukemia (e.g., B cell leukemias, T cell leukemias, Sezary syndrome, and Hairy cell leukemia), chronic myelocytic (myeloid, myelogenous, or granulocytic) leukemia, Hodgkin's lymphoma, non-hodgkin's lymphoma, Burkitt's lymphoma, and mycosis fungoides.

In other embodiments, the polynucleotides, polypeptides, antibodies, and/or agonists or antagonists of the present invention may be useful in diagnosing, prognosing, preventing, and/or treating diseases and disorders of plasma cells including, but not limited to, plasma cell dyscrasias, monoclonal gammaopathies, monoclonal gammopathies of undetermined significance, multiple myeloma, macroglobulinemia, Waldenstrom's macroglobulinemia, cryoglobulinemia, and Raynaud's phenomenon.

In other embodiments, the polynucleotides, polypeptides, antibodies, and/or agonists or antagonists of the present invention may be useful in treating, preventing, and/or diagnosing myeloproliferative disorders, including but not limited to, polycythemia vera, relative polycythemia, secondary polycythemia, myelofibrosis, acute myelofibrosis, agnogenic myelod metaplasia, thrombocythemia, (including both primary and secondary thrombocythemia) and chronic myelocytic leukemia.

In other embodiments, the polynucleotides, polypeptides, antibodies, and/or agonists or antagonists of the present invention may be useful as a treatment prior to surgery, to increase blood cell production.

In other embodiments, the polynucleotides, polypeptides, antibodies, and/or agonists or antagonists of the present invention may be useful as an agent to enhance the migration, phagocytosis, superoxide production, antibody dependent cellular cytotoxicity of neutrophils, eosionophils and macrophages.

In other embodiments, the polynucleotides, polypeptides, antibodies, and/or agonists or antagonists of the present invention may be useful as an agent to increase the number of stem cells in circulation prior to stem cells pheresis. In another specific embodiment, the polynucleotides, polypeptides, antibodies, and/or agonists or antagonists of the present invention may be useful as an agent to increase the number of stem cells in circulation prior to platelet pheresis.

In other embodiments, the polynucleotides, polypeptides, antibodies, and/or agonists or antagonists of the present invention may be useful as an agent to increase cytokine production.

In other embodiments, the polynucleotides, polypeptides, antibodies, and/or agonists or antagonists of the present invention may be useful in preventing, diagnosing, and/or treating primary hematopoietic disorders.

Hyperproliferative Disorders

In certain embodiments, polynucleotides or polypeptides, or agonists or antagonists of the present invention can be used to treat or detect hyperproliferative disorders, including neoplasms. Polynucleotides or polypeptides, or agonists or antagonists of the present invention may inhibit the proliferation of the disorder through direct or indirect interactions. Alternatively, Polynucleotides or polypeptides, or agonists or antagonists of the present invention may proliferate other cells which can inhibit the hyperproliferative disorder.

For example, by increasing an immune response, particularly increasing antigenic qualities of the hyperproliferative disorder or by proliferating, differentiating, or mobilizing T-cells, hyperproliferative disorders can be treated. This immune response may be increased by either enhancing an existing immune response, or by initiating a new immune response. Alternatively, decreasing an immune response may also be a method of treating hyperproliferative disorders, such as a chemotherapeutic agent.

Examples of hyperproliferative disorders that can be treated, or detected by polynucleotides or polypeptides, or agonists or antagonists of the present invention include, but are not limited to neoplasms located in the: colon, abdomen, bone, breast, digestive system, liver, pancreas, peritoneum, endocrine glands (adrenal, parathyroid, pituitary, testicles, ovary, thymus, thyroid), eye, head and neck, nervous (central and peripheral), lymphatic system, pelvis, skin, soft tissue, spleen, thorax, and urogenital tract.

Similarly, other hyperproliferative disorders can also be treated or detected by polynucleotides or polypeptides, or agonists or antagonists of the present invention. Examples of such hyperproliferative disorders include, but are not limited to: Acute Childhood Lymphoblastic Leukemia, Acute Lymphoblastic Leukemia, Acute Lymphocytic Leukemia, Acute Myeloid Leukemia, Adrenocortical Carcinoma, Adult (Primary) Hepatocellular Cancer, Adult (Primary) Liver Cancer, Adult Acute Lymphocytic Leukemia, Adult Acute Myeloid Leukemia, Adult Hodgkin's Disease, Adult Hodgkin's Lymphoma, Adult Lymphocytic Leukemia, Adult Non-Hodgkin's Lymphoma, Adult Primary Liver Cancer, Adult Soft Tissue Sarcoma, AIDS-Related Lymphoma, AIDS-Related Malignancies, Anal Cancer, Astrocytoma, Bile Duct Cancer, Bladder Cancer, Bone Cancer, Brain Stem Glioma, Brain Tumors, Breast Cancer, Cancer of the Renal Pelvis and Ureter, Central Nervous System (Primary) Lymphoma, Central Nervous System Lymphoma, Cerebellar Astrocytoma, Cerebral Astrocytoma, Cervical Cancer, Childhood (Primary) Hepatocellular Cancer, Childhood (Primary) Liver Cancer, Childhood Acute Lymphoblastic Leukemia, Childhood Acute Myeloid Leukemia, Childhood Brain Stem Glioma, Childhood Cerebellar Astrocytoma, Childhood Cerebral Astrocytoma, Childhood Extracranial Germ Cell Tumors, Childhood Hodgkin's Disease, Childhood Hodgkin's Lymphoma, Childhood Hypothalamic and Visual Pathway Glioma, Childhood Lymphoblastic Leukemia, Childhood Medulloblastoma, Childhood Non-Hodgkin's Lymphoma, Childhood Pineal and Supratentorial Primitive Neuroectodermal Tumors, Childhood Primary Liver Cancer, Childhood Rhabdomyosarcoma, Childhood Soft Tissue Sarcoma, Childhood Visual Pathway and Hypothalamic Glioma, Chronic Lymphocytic Leukemia, Chronic Myelogenous Leukemia, Colon Cancer, Cutaneous T-Cell Lymphoma, Endocrine Pancreas Islet Cell Carcinoma, Endometrial Cancer, Ependymoma, Epithelial Cancer, Esophageal Cancer, Ewing's Sarcoma and Related Tumors, Exocrine Pancreatic Cancer, Extracranial Germ Cell Tumor, Extragonadal Germ Cell Tumor, Extrahepatic Bile Duct Cancer, Eye Cancer, Female Breast Cancer, Gaucher's Disease, Gallbladder Cancer, Gastric Cancer, Gastrointestinal Carcinoid Tumor, Gastrointestinal Tumors, Germ Cell Tumors, Gestational Trophoblastic Tumor, Hairy Cell Leukemia, Head and Neck Cancer, Hepatocellular Cancer, Hodgkin's Disease, Hodgkin's Lymphoma, Hypergammaglobulinemia, Hypopharyngeal Cancer, Intestinal Cancers, Intraocular Melanoma, Islet Cell Carcinoma, Islet Cell Pancreatic Cancer, Kaposi's Sarcoma, Kidney Cancer, Laryngeal Cancer, Lip and Oral Cavity Cancer, Liver Cancer, Lung Cancer, Lymphoproliferative Disorders, Macroglobulinemia, Male Breast Cancer, Malignant Mesothelioma, Malignant Thymoma, Medulloblastoma, Melanoma, Mesothelioma, Metastatic Occult Primary Squamous Neck Cancer, Metastatic Primary Squamous Neck Cancer, Metastatic Squamous Neck Cancer, Multiple Myeloma, Multiple Myeloma/Plasma Cell Neoplasm, Myelodysplastic Syndrome, Myelogenous Leukemia, Myeloid Leukemia, Myeloproliferative Disorders, Nasal Cavity and Paranasal Sinus Cancer, Nasopharyngeal Cancer, Neuroblastoma, Non-Hodgkin's Lymphoma During Pregnancy, Nonmelanoma Skin Cancer, Non-Small Cell Lung Cancer, Occult Primary Metastatic Squamous Neck Cancer, Oropharyngeal Cancer, Osteo/Malignant Fibrous Sarcoma, Osteosarcoma/Malignant Fibrous Histiocytoma, Osteosarcoma/Malignant Fibrous Histiocytoma of Bone, Ovarian Epithelial Cancer, Ovarian Germ Cell Tumor, Ovarian Low Malignant Potential Tumor, Pancreatic Cancer, Paraproteinemias, Purpura, Parathyroid Cancer, Penile Cancer, Pheochromocytoma, Pituitary Tumor, Plasma Cell Neoplasm/Multiple Myeloma, Primary Central Nervous System Lymphoma, Primary Liver Cancer, Prostate Cancer, Rectal Cancer, Renal Cell Cancer, Renal Pelvis and Ureter Cancer, Retinoblastoma, Rhabdomyosarcoma, Salivary Gland Cancer, Sarcoidosis Sarcomas, Sezary Syndrome, Skin Cancer, Small Cell Lung Cancer, Small Intestine Cancer, Soft Tissue Sarcoma, Squamous Neck Cancer, Stomach Cancer, Supratentorial Primitive Neuroectodermal and Pineal Tumors, T-Cell Lymphoma, Testicular Cancer, Thymoma, Thyroid Cancer, Transitional Cell Cancer of the Renal Pelvis and Ureter, Transitional Renal Pelvis and Ureter Cancer, Trophoblastic Tumors, Ureter and Renal Pelvis Cell Cancer, Urethral Cancer, Uterine Cancer, Uterine Sarcoma, Vaginal Cancer, Visual Pathway and Hypothalamic Glioma, Vulvar Cancer, Waldenstrom's Macroglobulinemia, Wilms' Tumor, and any other hyperproliferative disease, besides neoplasia, located in an organ system listed above.

In another preferred embodiment, polynucleotides or polypeptides, or agonists or antagonists of the present invention are used to diagnose, prognose, prevent, and/or treat premalignant conditions and to prevent progression to a neoplastic or malignant state, including but not limited to those disorders described above. Such uses are indicated in conditions known or suspected of preceding progression to neoplasia or cancer, in particular, where non-neoplastic cell growth consisting of hyperplasia, metaplasia, or most particularly, dysplasia has occurred (for review of such abnormal growth conditions, see Robbins and Angell, 1976, Basic Pathology, 2d Ed., W.B. Saunders Co., Philadelphia, pp. 68-79.)

Hyperplasia is a form of controlled cell proliferation, involving an increase in cell number in a tissue or organ, without significant alteration in structure or function. Hyperplastic disorders which can be diagnosed, prognosed, prevented, and/or treated with compositions of the invention (including polynucleotides, polypeptides, agonists or antagonists) include, but are not limited to, angiofollicular mediastinal lymph node hyperplasia, angiolymphoid hyperplasia with eosinophilia, atypical melanocytic hyperplasia, basal cell hyperplasia, benign giant lymph node hyperplasia, cementum hyperplasia, congenital adrenal hyperplasia, congenital sebaceous hyperplasia, cystic hyperplasia, cystic hyperplasia of the breast, denture hyperplasia, ductal hyperplasia, endometrial hyperplasia, fibromuscular hyperplasia, focal epithelial hyperplasia, gingival hyperplasia, inflammatory fibrous hyperplasia, inflammatory papillary hyperplasia, intravascular papillary endothelial hyperplasia, nodular hyperplasia of prostate, nodular regenerative hyperplasia, pseudoepitheliomatous hyperplasia, senile sebaceous hyperplasia, and verrucous hyperplasia.

Metaplasia is a form of controlled cell growth in which one type of adult or fully differentiated cell substitutes for another type of adult cell. Metaplastic disorders which can be diagnosed, prognosed, prevented, and/or treated with compositions of the invention (including polynucleotides, polypeptides, agonists or antagonists) include, but are not limited to, agnogenic myeloid metaplasia, apocrine metaplasia, atypical metaplasia, autoparenchymatous metaplasia, connective tissue metaplasia, epithelial metaplasia, intestinal metaplasia, metaplastic anemia, metaplastic ossification, metaplastic polyps, myeloid metaplasia, primary myeloid metaplasia, secondary myeloid metaplasia, squamous metaplasia, squamous metaplasia of amnion, and symptomatic myeloid metaplasia.

Dysplasia is frequently a forerunner of cancer, and is found mainly in the epithelia; it is the most disorderly form of non-neoplastic cell growth, involving a loss in individual cell uniformity and in the architectural orientation of cells. Dysplastic cells often have abnormally large, deeply stained nuclei, and exhibit pleomorphism. Dysplasia characteristically occurs where there exists chronic irritation or inflammation. Dysplastic disorders which can be diagnosed, prognosed, prevented, and/or treated with compositions of the invention (including polynucleotides, polypeptides, agonists or antagonists) include, but are not limited to, anhidrotic ectodermal dysplasia, anterofacial dysplasia, asphyxiating thoracic dysplasia, atriodigital dysplasia, bronchopulmonary dysplasia, cerebral dysplasia, cervical dysplasia, chondroectodermal dysplasia, cleidocranial dysplasia, congenital ectodermal dysplasia, craniodiaphysial dysplasia, craniocarpotarsal dysplasia, craniometaphysial dysplasia, dentin dysplasia, diaphysial dysplasia, ectodermal dysplasia, enamel dysplasia, encephalo-ophthalmic dysplasia, dysplasia epiphysialis hemimelia, dysplasia epiphysialis multiplex, dysplasia epiphysialis punctata, epithelial dysplasia, faciodigitogenital dysplasia, familial fibrous dysplasia of jaws, familial white folded dysplasia, fibromuscular dysplasia, fibrous dysplasia of bone, florid osseous dysplasia, hereditary renal-retinal dysplasia, hidrotic ectodermal dysplasia, hypohidrotic ectodermal dysplasia, lymphopenic thymic dysplasia, mammary dysplasia, mandibulofacial dysplasia, metaphysial dysplasia, Mondini dysplasia, monostotic fibrous dysplasia, mucoepithelial dysplasia, multiple epiphysial dysplasia, oculoauriculovertebral dysplasia, oculodentodigital dysplasia, oculovertebral dysplasia, odontogenic dysplasia, ophthalmomandibulomelic dysplasia, periapical cemental dysplasia, polyostotic fibrous dysplasia, pseudoachondroplastic spondyloepiphysial dysplasia, retinal dysplasia, septo-optic dysplasia, spondyloepiphysial dysplasia, and ventriculoradial dysplasia.

Additional pre-neoplastic disorders which can be diagnosed, prognosed, prevented, and/or treated with compositions of the invention (including polynucleotides, polypeptides, agonists or antagonists) include, but are not limited to, benign dysproliferative disorders (e.g., benign tumors, fibrocystic conditions, tissue hypertrophy, intestinal polyps, colon polyps, and esophageal dysplasia), leukoplakia, keratoses, Bowen's disease, Farmer's Skin, solar cheilitis, and solar keratosis.

In another embodiment, a polypeptide of the invention, or polynucleotides, antibodies, agonists, or antagonists corresponding to that polypeptide, may be used to diagnose and/or prognose disorders associated with the tissue(s) in which the polypeptide of the invention is expressed, including one, two, three, four, five, or more tissues disclosed in Table 1B.2, column 5 (Tissue Distribution Library Code).

In another embodiment, polynucleotides, polypeptides, antibodies, and/or agonists or antagonists of the present invention conjugated to a toxin or a radioactive isotope, as described herein, may be used to treat cancers and neoplasms, including, but not limited to those described herein. In a further preferred embodiment, polynucleotides, polypeptides, antibodies, and/or agonists or antagonists of the present invention conjugated to a toxin or a radioactive isotope, as described herein, may be used to treat acute myelogenous leukemia.

Additionally, polynucleotides, polypeptides, and/or agonists or antagonists of the invention may affect apoptosis, and therefore, would be useful in treating a number of diseases associated with increased cell survival or the inhibition of apoptosis. For example, diseases associated with increased cell survival or the inhibition of apoptosis that could be diagnosed, prognosed, prevented, and/or treated by polynucleotides, polypeptides, and/or agonists or antagonists of the invention, include cancers (such as follicular lymphomas, carcinomas with p53 mutations, and hormone-dependent tumors, including, but not limited to colon cancer, cardiac tumors, pancreatic cancer, melanoma, retinoblastoma, glioblastoma, lung cancer, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, breast cancer, prostate cancer, Kaposi's sarcoma and ovarian cancer); autoimmune disorders such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) and viral infections (such as herpes viruses, pox viruses and adenoviruses), inflammation, graft v. host disease, acute graft rejection, and chronic graft rejection.

In preferred embodiments, polynucleotides, polypeptides, and/or agonists or antagonists of the invention are used to inhibit growth, progression, and/or metastasis of cancers, in particular those listed above.

Additional diseases or conditions associated with increased cell survival that could be diagnosed, prognosed, prevented, and/or treated by polynucleotides, polypeptides, and/or agonists or antagonists of the invention, include, but are not limited to, progression, and/or metastases of malignancies and related disorders such as leukemia (including acute leukemias (e.g., acute lymphocytic leukemia, acute myelocytic leukemia (including myeloblastic, promyelocytic, myelomonocytic, monocytic, and erythroleukemia)) and chronic leukemias (e.g., chronic myelocytic (granulocytic) leukemia and chronic lymphocytic leukemia)), polycythemia vera, lymphomas (e.g., Hodgkin's disease and non-Hodgkin's disease), multiple myeloma, Waldenstrom's macroglobulinemia, heavy chain disease, and solid tumors including, but not limited to, sarcomas and carcinomas such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, emangioblastoma, acoustic neuroma, oligodendroglioma, menangioma, melanoma, neuroblastoma, and retinoblastoma.

Diseases associated with increased apoptosis that could be diagnosed, prognosed, prevented, and/or treated by polynucleotides, polypeptides, and/or agonists or antagonists of the invention, include AIDS; neurodegenerative disorders (such as Alzheimer's disease, Parkinson's disease, amyotrophic lateral sclerosis, retinitis pigmentosa, cerebellar degeneration and brain tumor or prior associated disease); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) myelodysplastic syndromes (such as aplastic anemia), graft v. host disease, ischemic injury (such as that caused by myocardial infarction, stroke and reperfusion injury), liver injury (e.g., hepatitis related liver injury, ischemia/reperfusion injury, cholestosis (bile duct injury) and liver cancer); toxin-induced liver disease (such as that caused by alcohol), septic shock, cachexia and anorexia.

Hyperproliferative diseases and/or disorders that could be diagnosed, prognosed, prevented, and/or treated by polynucleotides, polypeptides, and/or agonists or antagonists of the invention, include, but are not limited to, neoplasms located in the liver, abdomen, bone, breast, digestive system, pancreas, peritoneum, endocrine glands (adrenal, parathyroid, pituitary, testicles, ovary, thymus, thyroid), eye, head and neck, nervous system (central and peripheral), lymphatic system, pelvis, skin, soft tissue, spleen, thorax, and urogenital tract.

Similarly, other hyperproliferative disorders can also be diagnosed, prognosed, prevented, and/or treated by polynucleotides, polypeptides, and/or agonists or antagonists of the invention. Examples of such hyperproliferative disorders include, but are not limited to: hypergammaglobulinemia, lymphoproliferative disorders, paraproteinemias, purpura, sarcoidosis, Sezary Syndrome, Waldenstron's macroglobulinemia, Gaucher's Disease, histiocytosis, and any other hyperproliferative disease, besides neoplasia, located in an organ system listed above.

Another preferred embodiment utilizes polynucleotides of the present invention to inhibit aberrant cellular division, by gene therapy using the present invention, and/or protein fusions or fragments thereof.

Thus, the present invention provides a method for treating cell proliferative disorders by inserting into an abnormally proliferating cell a polynucleotide of the present invention, wherein said polynucleotide represses said expression.

Another embodiment of the present invention provides a method of treating cell-proliferative disorders in individuals comprising administration of one or more active gene copies of the present invention to an abnormally proliferating cell or cells. In a preferred embodiment, polynucleotides of the present invention is a DNA construct comprising a recombinant expression vector effective in expressing a DNA sequence encoding said polynucleotides. In another preferred embodiment of the present invention, the DNA construct encoding the polynucleotides of the present invention is inserted into cells to be treated utilizing a retrovirus, or more preferably an adenoviral vector (See G J. Nabel, et. al., PNAS 1999 96: 324-326, which is hereby incorporated by reference). In a most preferred embodiment, the viral vector is defective and will not transform non-proliferating cells, only proliferating cells. Moreover, in a preferred embodiment, the polynucleotides of the present invention inserted into proliferating cells either alone, or in combination with or fused to other polynucleotides, can then be modulated via an external stimulus (i.e. magnetic, specific small molecule, chemical, or drug administration, etc.), which acts upon the promoter upstream of said polynucleotides to induce expression of the encoded protein product. As such the beneficial therapeutic affect of the present invention may be expressly modulated (i.e. to increase, decrease, or inhibit expression of the present invention) based upon said external stimulus.

Polynucleotides of the present invention may be useful in repressing expression of oncogenic genes or antigens. By "repressing expression of the oncogenic genes" is intended the suppression of the transcription of the gene, the degradation of the gene transcript (pre-message RNA), the inhibition of splicing, the destruction of the messenger RNA, the prevention of the post-translational modifications of the protein, the destruction of the protein, or the inhibition of the normal function of the protein.

For local administration to abnormally proliferating cells, polynucleotides of the present invention may be administered by any method known to those of skill in the art including, but not limited to transfection, electroporation, microinjection of cells, or in vehicles such as liposomes, LIPOFECTIN™, or as naked polynucleotides, or any other method described throughout the specification. The polynucleotide of the present invention may be delivered by known gene delivery systems such as, but not limited to, retroviral vectors (Gilboa, J. Virology 44:845 (1982); Hocke, Nature 320:275 (1986); Wilson, et al., Proc. Natl. Acad. Sci. U.S.A. 85:3014), vaccinia virus system (Chakrabarty et al., Mol. Cell Biol. 5:3403 (1985) or other efficient DNA delivery systems (Yates et al., Nature 313:812 (1985)) known to those skilled in the art. These references are exemplary only and are hereby incorporated by reference. In order to specifically deliver or transfect cells which are abnormally proliferating and spare non-dividing cells, it is preferable to utilize a retrovirus, or adenoviral (as described in the art and elsewhere herein) delivery system known to those of skill in the art. Since host DNA replication is required for retroviral DNA to integrate and the retrovirus will be unable to self replicate due to the lack of the retrovirus genes needed for its life cycle. Utilizing such a retroviral delivery system for polynucleotides of the present invention will target said gene and constructs to abnormally proliferating cells and will spare the non-dividing normal cells.

The polynucleotides of the present invention may be delivered directly to cell proliferative disorder/disease sites in internal organs, body cavities and the like by use of imaging devices used to guide an injecting needle directly to the disease site. The polynucleotides of the present invention may also be administered to disease sites at the time of surgical intervention.

By "cell proliferative disease" is meant any human or animal disease or disorder, affecting any one or any combination of organs, cavities, or body parts, which is characterized by single or multiple local abnormal proliferations of cells, groups of cells, or tissues, whether benign or malignant.

Any amount of the polynucleotides of the present invention may be administered as long as it has a biologically inhibiting effect on the proliferation of the treated cells. Moreover, it is possible to administer more than one of the polynucleotide of the present invention simultaneously to the same site. By "biologically inhibiting" is meant partial or total growth inhibition as well as decreases in the rate of proliferation or growth of the cells. The biologically inhibitory dose may be determined by assessing the effects of the polynucleotides of the present invention on target malignant or abnormally proliferating cell growth in tissue culture, tumor growth in animals and cell cultures, or any other method known to one of ordinary skill in the art.

The present invention is further directed to antibody-based therapies which involve administering of anti-polypeptides and anti-polynucleotide antibodies to a mammalian, preferably human, patient for treating one or more of the described disorders. Methods for producing anti-polypeptides and anti-polynucleotide antibodies polyclonal and monoclonal antibodies are described in detail elsewhere herein. Such antibodies may be provided in pharmaceutically acceptable compositions as known in the art or as described herein.

A summary of the ways in which the antibodies of the present invention may be used therapeutically includes binding polynucleotides or polypeptides of the present invention locally or systemically in the body or by direct cytotoxicity of the antibody, e.g. as mediated by complement (CDC) or by effector cells (ADCC). Some of these approaches are described in more detail below. Armed with the teachings provided herein, one of ordinary skill in the art will know how to use the antibodies of the present invention for diagnostic, monitoring or therapeutic purposes without undue experimentation.

In particular, the antibodies, fragments and derivatives of the present invention are useful for treating a subject having or developing cell proliferative and/or differentiation disorders as described herein. Such treatment comprises administering a single or multiple doses of the antibody, or a fragment, derivative, or a conjugate thereof.

The antibodies of this invention may be advantageously utilized in combination with other monoclonal or chimeric antibodies, or with lymphokines or hematopoietic growth factors, for example, which serve to increase the number or activity of effector cells which interact with the antibodies.

It is preferred to use high affinity and/or potent in vivo inhibiting and/or neutralizing antibodies against polypeptides or polynucleotides of the present invention, fragments or regions thereof, for both immunoassays directed to and therapy of disorders related to polynucleotides or polypeptides, including fragments thereof, of the present invention. Such antibodies, fragments, or regions, will preferably have an affinity for polynucleotides or polypeptides, including fragments thereof. Preferred binding affinities include those with a dissociation constant or Kd less than $5\times10^{-6}$M, $10^{-6}$M, $5\times10^{-7}$M, $10^{-7}$M, $5\times10^{-8}$M, $10^{-8}$M, $5\times10^{-9}$M, $10^{-9}$M, $5\times10^{-10}$M, $10^{-10}$M, $5\times10^{-11}$M, $10^{-11}$M, $5\times10^{-12}$M, $10^{-12}$M, $5\times10^{-13}$M, $10^{-13}$M, $5\times10^{-14}$M, $10^{-14}$M, $5\times10^{-15}$M, and $10^{-15}$M.

Moreover, polypeptides of the present invention are useful in inhibiting the angiogenesis of proliferative cells or tissues, either alone, as a protein fusion, or in combination with other polypeptides directly or indirectly, as described elsewhere herein. In a most preferred embodiment, said anti-angiogenesis effect may be achieved indirectly, for example, through the inhibition of hematopoietic, tumor-specific cells, such as tumor-associated macrophages (See Joseph I B, et al. J Natl Cancer Inst, 90(21):1648-53 (1998), which is hereby incorporated by reference). Antibodies directed to polypeptides or polynucleotides of the present invention may also result in inhibition of angiogenesis directly, or indirectly (See Witte L, et al., Cancer Metastasis Rev. 17(2):155-61 (1998), which is hereby incorporated by reference)).

Polypeptides, including protein fusions, of the present invention, or fragments thereof may be useful in inhibiting proliferative cells or tissues through the induction of apoptosis. Said polypeptides may act either directly, or indirectly to induce apoptosis of proliferative cells and tissues, for example in the activation of a death-domain receptor, such as tumor necrosis factor (TNF) receptor-1, CD95 (Fas/APO-1), TNF-receptor-related apoptosis-mediated protein (TRAMP) and TNF-related apoptosis-inducing ligand (TRAIL) receptor-1 and -2 (See Schulze-Osthoff K, et. al., Eur J Biochem 254(3):439-59 (1998), which is hereby incorporated by reference). Moreover, in another preferred embodiment of the present invention, said polypeptides may induce apoptosis through other mechanisms, such as in the activation of other proteins which will activate apoptosis, or through stimulating the expression of said proteins, either alone or in combination with small molecule drugs or adjuvants, such as apoptonin, galectins, thioredoxins, anti-inflammatory proteins (See for example, Mutat Res 400(1-2):447-55 (1998), Med Hypotheses. 50(5):423-33 (1998), Chem Biol Interact. April 24;111-112:23-34 (1998), J Mol Med. 76(6):402-12 (1998), Int J Tissue React; 20(1):3-15 (1998), which are all hereby incorporated by reference).

Polypeptides, including protein fusions to, or fragments thereof, of the present invention are useful in inhibiting the metastasis of proliferative cells or tissues. Inhibition may occur as a direct result of administering polypeptides, or antibodies directed to said polypeptides as described elsewhere herein, or indirectly, such as activating the expression of proteins known to inhibit metastasis, for example alpha 4 integrins, (See, e.g., Curr Top Microbiol Immunol 1998; 231: 125-41, which is hereby incorporated by reference). Such therapeutic affects of the present invention may be achieved either alone, or in combination with small molecule drugs or adjuvants.

In another embodiment, the invention provides a method of delivering compositions containing the polypeptides of the invention (e.g., compositions containing polypeptides or polypeptide antibodies associated with heterologous polypeptides, heterologous nucleic acids, toxins, or prodrugs) to targeted cells expressing the polypeptide of the present invention. Polypeptides or polypeptide antibodies of the invention may be associated with with heterologous polypeptides, heterologous nucleic acids, toxins, or prodrugs via hydrophobic, hydrophilic, ionic and/or covalent interactions.

Polypeptides, protein fusions to, or fragments thereof, of the present invention are useful in enhancing the immunogenicity and/or antigenicity of proliferating cells or tissues, either directly, such as would occur if the polypeptides of the present invention 'vaccinated' the immune response to respond to proliferative antigens and immunogens, or indirectly, such as in activating the expression of proteins known to enhance the immune response (e.g. chemokines), to said antigens and immunogens.

Renal Disorders

Polynucleotides, polypeptides, antibodies, and/or agonists or antagonists of the present invention, may be used to treat, prevent, diagnose, and/or prognose disorders of the renal system. Renal disorders which can be diagnosed, prognosed, prevented, and/or treated with compositions of the invention include, but are not limited to, kidney failure, nephritis, blood vessel disorders of kidney, metabolic and congenital kidney disorders, urinary disorders of the kidney, autoimmune disorders, sclerosis and necrosis, electrolyte imbalance, and kidney cancers.

Kidney diseases which can be diagnosed, prognosed, prevented, and/or treated with compositions of the invention include, but are not limited to, acute kidney failure, chronic kidney failure, atheroembolic renal failure, end-stage renal disease, inflammatory diseases of the kidney (e.g., acute glomerulonephritis, postinfectious glomerulonephritis, rapidly progressive glomerulonephritis, nephrotic syndrome, membranous glomerulonephritis, familial nephrotic syndrome, membranoproliferative glomerulonephritis I and II, mesangial proliferative glomerulonephritis, chronic glomerulonephritis, acute tubulointerstitial nephritis, chronic tubulointerstitial nephritis, acute post-streptococcal glomerulonephritis (PSGN), pyelonephritis, lupus nephritis, chronic nephritis, interstitial nephritis, and post-streptococcal glomerulonephritis), blood vessel disorders of the kidneys (e.g., kidney infarction, atheroembolic kidney disease, cortical necrosis, malignant nephrosclerosis, renal vein thrombosis, renal underperfusion, renal retinopathy, renal ischemia-reperfusion, renal artery embolism, and renal artery stenosis), and kidney disorders resulting form urinary tract disease (e.g., pyelonephritis, hydronephrosis, urolithiasis (renal lithiasis, nephrolithiasis), reflux nephropathy, urinary tract infections, urinary retention, and acute or chronic unilateral obstructive uropathy.)

In addition, compositions of the invention can be used to diagnose, prognose, prevent, and/or treat metabolic and congenital disorders of the kidney (e.g., uremia, renal amyloidosis, renal osteodystrophy, renal tubular acidosis, renal glycosuria, nephrogenic diabetes insipidus, cystinuria, Fanconi's syndrome, renal fibrocystic osteosis (renal rickets), Hartnup disease, Bartter's syndrome, Liddle's syndrome, polycystic kidney disease, medullary cystic disease, medullary sponge kidney, Alport's syndrome, nail-patella syndrome, congenital nephrotic syndrome, CRUSH syndrome, horseshoe kidney, diabetic nephropathy, nephrogenic diabetes insipidus, analgesic nephropathy, kidney stones, and membranous nephropathy), and autoimmune disorders of the kidney (e.g., systemic lupus erythematosus (SLE), Goodpasture syndrome, IgA nephropathy, and IgM mesangial proliferative glomerulonephritis).

Compositions of the invention can also be used to diagnose, prognose, prevent, and/or treat sclerotic or necrotic disorders of the kidney (e.g., glomerulosclerosis, diabetic nephropathy, focal segmental glomerulosclerosis (FSGS), necrotizing glomerulonephritis, and renal papillary necrosis), cancers of the kidney (e.g., nephroma, hypemephroma, nephroblastoma, renal cell cancer, transitional cell cancer, renal adenocarcinoma, squamous cell cancer, and Wilm's tumor), and electrolyte imbalances (e.g., nephrocalcinosis, pyuria, edema, hydronephritis, proteinuria, hyponatremia, hypematremia, hypokalemia, hyperkalemia, hypocalcemia, hypercalcemia, hypophosphatemia, and hyperphosphatemia).

Polypeptides may be administered using any method known in the art, including, but not limited to, direct needle injection at the delivery site, intravenous injection, topical administration, catheter infusion, biolistic injectors, particle accelerators, gelfoam sponge depots, other commercially available depot materials, osmotic pumps, oral or suppositorial solid pharmaceutical formulations, decanting or topical applications during surgery, aerosol delivery. Such methods are known in the art. Polypeptides may be administered as part of a Therapeutic, described in more detail below. Methods of delivering polynucleotides are described in more detail herein.

Cardiovascular Disorders

Polynucleotides or polypeptides, or agonists or antagonists of the present invention, may be used to treat, prevent, diagnose, and/or prognose cardiovascular disorders, including, but not limited to, peripheral artery disease, such as limb ischemia.

Cardiovascular disorders include, but are not limited to, cardiovascular abnormalities, such as arterio-arterial fistula, arteriovenous fistula, cerebral arteriovenous malformations, congenital heart defects, pulmonary atresia, and Scimitar Syndrome. Congenital heart defects include, but are not limited to, aortic coarctation, cortriatriatum, coronary vessel anomalies, crisscross heart, dextrocardia, patent ductus arteriosus, Ebstein's anomaly, Eisenmenger complex, hypoplastic left heart syndrome, levocardia, tetralogy of fallot, transposition of great vessels, double outlet right ventricle, tricuspid atresia, persistent truncus arteriosus, and heart septal defects, such as aortopulmonary septal defect, endocardial cushion defects, Lutembacher's Syndrome, trilogy of Fallot, ventricular heart septal defects.

Cardiovascular disorders also include, but are not limited to, heart disease, such as arrhythmias, carcinoid heart disease, high cardiac output, low cardiac output, cardiac tamponade, endocarditis (including bacterial), heart aneurysm, cardiac arrest, congestive heart failure, congestive cardiomyopathy, paroxysmal dyspnea, cardiac edema, heart hypertrophy, congestive cardiomyopathy, left ventricular hypertrophy, right ventricular hypertrophy, post-infarction heart rupture, ventricular septal rupture, heart valve diseases, myocardial diseases, myocardial ischemia, pericardial effusion, pericarditis (including constrictive and tuberculous), pneumopericardium, postpericardiotomy syndrome, pulmonary heart disease, rheumatic heart disease, ventricular dysfunction, hyperemia, cardiovascular pregnancy complications, Scimitar Syndrome, cardiovascular syphilis, and cardiovascular tuberculosis.

Arrhythmias include, but are not limited to, sinus arrhythmia, atrial fibrillation, atrial flutter, bradycardia, extrasystole, Adams-Stokes Syndrome, bundle-branch block, sinoatrial block, long QT syndrome, parasystole, Lown-Ganong-Levine Syndrome, Mahaim-type pre-excitation syndrome, Wolff-Parkinson-White syndrome, sick sinus syndrome, tachycardias, and ventricular fibrillation. Tachycardias include paroxysmal tachycardia, supraventricular tachycardia, accelerated idioventricular rhythm, atrioventricular nodal reentry tachycardia, ectopic atrial tachycardia, ectopic junctional tachycardia, sinoatrial nodal reentry tachycardia, sinus tachycardia, Torsades de Pointes, and ventricular tachycardia.

Heart valve diseases include, but are not limited to, aortic valve insufficiency, aortic valve stenosis, hear murmurs, aortic valve prolapse, mitral valve prolapse, tricuspid valve prolapse, mitral valve insufficiency, mitral valve stenosis, pulmonary atresia, pulmonary valve insufficiency, pulmonary valve stenosis, tricuspid atresia, tricuspid valve insufficiency, and tricuspid valve stenosis.

Myocardial diseases include, but are not limited to, alcoholic cardiomyopathy, congestive cardiomyopathy, hypertrophic cardiomyopathy, aortic subvalvular stenosis, pulmonary subvalvular stenosis, restrictive cardiomyopathy, Chagas cardiomyopathy, endocardial fibroelastosis, endomyocardial fibrosis, Kearns Syndrome, myocardial reperfusion injury, and myocarditis.

Myocardial ischemias include, but are not limited to, coronary disease, such as angina pectoris, coronary aneurysm, coronary arteriosclerosis, coronary thrombosis, coronary vasospasm, myocardial infarction and myocardial stunning.

Cardiovascular diseases also include vascular diseases such as aneurysms, angiodysplasia, angiomatosis, bacillary angiomatosis, Hippel-Lindau Disease, Klippel-Trenaunay-Weber Syndrome, Sturge-Weber Syndrome, angioneurotic edema, aortic diseases, Takayasu's Arteritis, aortitis, Leriche's Syndrome, arterial occlusive diseases, arteritis, enarteritis, polyarteritis nodosa, cerebrovascular disorders, diabetic angiopathies, diabetic retinopathy, embolisms, thrombosis, erythromelalgia, hemorrhoids, hepatic veno-occlusive disease, hypertension, hypotension, ischemia, peripheral vascular diseases, phlebitis, pulmonary veno-occlusive disease, Raynaud's disease, CREST syndrome, retinal vein occlusion, Scimitar syndrome, superior vena cava syndrome, telangiectasia, atacia telangiectasia, hereditary hemorrhagic telangiectasia, varicocele, varicose veins, varicose ulcer, vasculitis, and venous insufficiency.

Aneurysms include, but are not limited to, dissecting aneurysms, false aneurysms, infected aneurysms, ruptured aneurysms, aortic aneurysms, cerebral aneurysms, coronary aneurysms, heart aneurysms, and iliac aneurysms.

Arterial occlusive diseases include, but are not limited to, arteriosclerosis, intermittent claudication, carotid stenosis, fibromuscular dysplasias, mesenteric vascular occlusion, Moyamoya disease, renal artery obstruction, retinal artery occlusion, and thromboangiitis obliterans.

Cerebrovascular disorders include, but are not limited to, carotid artery diseases, cerebral amyloid angiopathy, cerebral aneurysm, cerebral anoxia, cerebral arteriosclerosis, cerebral arteriovenous malformation, cerebral artery diseases, cerebral embolism and thrombosis, carotid artery thrombosis, sinus thrombosis, Wallenberg's syndrome, cerebral hemorrhage, epidural hematoma, subdural hematoma, subaraxhnoid hemorrhage, cerebral infarction, cerebral ischemia (including transient), subdlavian steal syndrome, periventricular leukomalacia, vascular headache, cluster headache, migraine, and vertebrobasilar insufficiency.

Embolisms include, but are not limited to, air embolisms, amniotic fluid embolisms, cholesterol embolisms, blue toe syndrome, fat embolisms, pulmonary embolisms, and thromboembolisms. Thrombosis include, but are not limited to, coronary thrombosis, hepatic vein thrombosis, retinal vein occlusion, carotid artery thrombosis, sinus thrombosis, Wallenberg's syndrome, and thrombophlebitis.

Ischemic disorders include, but are not limited to, cerebral ischemia, ischemic colitis, compartment syndromes, anterior compartment syndrome, myocardial ischemia, reperfusion injuries, and peripheral limb ischemia. Vasculitis includes, but is not limited to, aortitis, arteritis, Behcet's Syndrome, Churg-Strauss Syndrome, mucocutaneous lymph node syndrome, thromboangiitis obliterans, hypersensitivity vasculitis, Schoenlein-Henoch purpura, allergic cutaneous vasculitis, and Wegener's granulomatosis.

Polypeptides may be administered using any method known in the art, including, but not limited to, direct needle injection at the delivery site, intravenous injection, topical administration, catheter infusion, biolistic injectors, particle accelerators, gelfoam sponge depots, other commercially available depot materials, osmotic pumps, oral or suppositorial solid pharmaceutical formulations, decanting or topical applications during surgery, aerosol delivery. Such methods are known in the art. Polypeptides may be administered as part of a Therapeutic, described in more detail below. Methods of delivering polynucleotides are described in more detail herein.

Respiratory Disorders

Polynucleotides or polypeptides, or agonists or antagonists of the present invention may be used to treat, prevent, diagnose, and/or prognose diseases and/or disorders of the respiratory system.

Diseases and disorders of the respiratory system include, but are not limited to, nasal vestibulitis, nonallergic rhinitis (e.g., acute rhinitis, chronic rhinitis, atrophic rhinitis, vasomotor rhinitis), nasal polyps, and sinusitis, juvenile angiofibromas, cancer of the nose and juvenile papillomas, vocal cord polyps, nodules (singer's nodules), contact ulcers, vocal cord paralysis, laryngoceles, pharyngitis (e.g., viral and bacterial), tonsillitis, tonsillar cellulitis, parapharyngeal abscess, laryngitis, laryngoceles, and throat cancers (e.g., cancer of the nasopharynx, tonsil cancer, larynx cancer), lung cancer (e.g., squamous cell carcinoma, small cell (oat cell) carcinoma, large cell carcinoma, and adenocarcinoma), allergic disorders (eosinophilic pneumonia, hypersensitivity pneumonitis (e.g., extrinsic allergic alveolitis, allergic interstitial pneumonitis, organic dust pneumoconiosis, allergic bronchopulmonary aspergillosis, asthma, Wegener's granulomatosis (granulomatous vasculitis), Goodpasture's syndrome)), pneumonia (e.g., bacterial pneumonia (e.g., *Streptococcus pneumoniae* (pneumoncoccal pneumonia), *Staphylococcus aureus* (staphylococcal pneumonia), Gram-negative bacterial pneumonia (caused by, e.g., *Klebsiella* and *Pseudomas* spp.), *Mycoplasma pneumoniae* pneumonia, *Hemophilus influenzae* pneumonia, *Legionella pneumophila* (Legionnaires' disease), and *Chlamydia psittaci* (Psittacosis)), and viral pneumonia (e.g., influenza, chickenpox (varicella).

Additional diseases and disorders of the respiratory system include, but are not limited to bronchiolitis, polio (poliomyelitis), croup, respiratory syncytial viral infection, mumps, erythema infectiosum (fifth disease), roseola infantum, progressive rubella panencephalitis, german measles, and subacute sclerosing panencephalitis), fungal pneumonia (e.g., Histoplasmosis, Coccidioidomycosis, Blastomycosis, fungal infections in people with severely suppressed immune systems (e.g., cryptococcosis, caused by *Cryptococcus neoformans*; aspergillosis, caused by *Aspergillus* spp.; candidiasis, caused by *Candida*; and mucormycosis)), *Pneumocystis carinii* (pneumocystis pneumonia), atypical pneumonias (e.g., *Mycoplasma* and *Chlamydia* spp.), opportunistic infection pneumonia, nosocomial pneumonia, chemical pneumonitis, and aspiration pneumonia, pleural disorders (e.g., pleurisy, pleural effusion, and pneumothorax (e.g., simple spontaneous pneumothorax, complicated spontaneous pneumothorax, tension pneumothorax)), obstructive airway diseases (e.g., asthma, chronic obstructive pulmonary disease (COPD), emphysema, chronic or acute bronchitis), occupational lung diseases (e.g., silicosis, black lung (coal workers' pneumoconiosis), asbestosis, berylliosis, occupational asthma, byssinosis, and benign pneumoconioses), Infiltrative Lung Disease (e.g., pulmonary fibrosis (e.g., fibrosing alveolitis, usual interstitial pneumonia), idiopathic pulmonary fibrosis, desquamative interstitial pneumonia, lymphoid interstitial pneumonia, histiocytosis X (e.g., Letterer-Siwe disease, Hand-Schüller-Christian disease, eosinophilic granuloma), idiopathic pulmonary hemosiderosis, sarcoidosis and pulmonary alveolar proteinosis), Acute respiratory distress syndrome (also called, e.g., adult respiratory distress syndrome), edema, pulmonary embolism, bronchitis (e.g., viral, bacterial), bronchiectasis, atelectasis, lung abscess (caused by, e.g., *Staphylococcus aureus* or *Legionella pneumophila*), and cystic fibrosis.

Anti-Angiogenesis Activity

The naturally occurring balance between endogenous stimulators and inhibitors of angiogenesis is one in which inhibitory influences predominate. Rastinejad et al., *Cell* 56:345-355 (1989). In those rare instances in which neovascularization occurs under normal physiological conditions, such as wound healing, organ regeneration, embryonic development, and female reproductive processes, angiogenesis is stringently regulated and spatially and temporally delimited. Under conditions of pathological angiogenesis such as that characterizing solid tumor growth, these regulatory controls fail. Unregulated angiogenesis becomes pathologic and sustains progression of many neoplastic and non-neoplastic diseases. A number of serious diseases are dominated by abnormal neovascularization including solid tumor growth and metastases, arthritis, some types of eye disorders, and psoriasis. See, e.g., reviews by Moses et al., *Biotech.* 9:630-634 (1991); Folkman et al., *N. Engl. J. Med.*, 333:1757-1763 (1995); Auerbach et al., *J. Microvasc. Res.* 29:401-411 (1985); Folkman, Advances in Cancer Research, eds. Klein and Weinhouse, Academic Press, New York, pp. 175-203 (1985); Patz, *Am. J. Opthalmol.* 94:715-743 (1982); and Folkman et al., Science 221:719-725 (1983). In a number of pathological conditions, the process of angiogenesis contributes to the disease state. For example, significant data have accumulated which suggest that the growth of solid tumors is dependent on angiogenesis. Folkman and Klagsbrun, *Science* 235:442-447 (1987).

The present invention provides for treatment of diseases or disorders associated with neovascularization by administration of the polynucleotides and/or polypeptides of the invention, as well as agonists or antagonists of the present invention. Malignant and metastatic conditions which can be treated with the polynucleotides and polypeptides, or agonists or antagonists of the invention include, but are not limited to, malignancies, solid tumors, and cancers described herein and otherwise known in the art (for a review of such disorders, see Fishman et al., Medicine, 2d Ed., J. B. Lippincott Co., Philadelphia (1985)). Thus, the present invention provides a method of treating an angiogenesis-related disease and/or disorder, comprising administering to an individual in need thereof a therapeutically effective amount of a polynucleotide, polypeptide, antagonist and/or agonist of the invention. For example, polynucleotides, polypeptides, antagonists and/or agonists may be utilized in a variety of additional methods in order to therapeutically treat a cancer or tumor. Cancers which may be treated with polynucleotides, polypeptides, antagonists and/or agonists include, but are not limited to solid tumors, including prostate, lung, breast, ovarian, stomach, pancreas, larynx, esophagus, testes, liver, parotid, biliary tract, colon, rectum, cervix, uterus, endometrium, kidney, bladder, thyroid cancer; primary tumors and metastases; melanomas; glioblastoma; Kaposi's sarcoma; leiomyosarcoma; non-small cell lung cancer; colorectal cancer; advanced malignancies; and blood born tumors such as leukemias. For example, polynucleotides, polypeptides, antagonists and/or agonists may be delivered topically, in order to treat cancers such as skin cancer, head and neck tumors, breast tumors, and Kaposi's sarcoma.

Within yet other aspects, polynucleotides, polypeptides, antagonists and/or agonists may be utilized to treat superficial forms of bladder cancer by, for example, intravesical administration. Polynucleotides, polypeptides, antagonists and/or agonists may be delivered directly into the tumor, or near the tumor site, via injection or a catheter. Of course, as the artisan of ordinary skill will appreciate, the appropriate mode of administration will vary according to the cancer to be treated. Other modes of delivery are discussed herein.

Polynucleotides, polypeptides, antagonists and/or agonists may be useful in treating other disorders, besides cancers, which involve angiogenesis. These disorders include, but are not limited to: benign tumors, for example hemangiomas, acoustic neuromas, neurofibromas, trachomas, and pyogenic granulomas; artheroscleric plaques; ocular angiogenic diseases, for example, diabetic retinopathy, retinopathy of prematurity, macular degeneration, corneal graft rejection, neovascular glaucoma, retrolental fibroplasia, rubeosis, retinoblastoma, uvietis and Pterygia (abnormal blood vessel growth) of the eye; rheumatoid arthritis; psoriasis; delayed wound healing; endometriosis; vasculogenesis; granulations; hypertrophic scars (keloids); nonunion fractures; scleroderma; trachoma; vascular adhesions; myocardial angiogenesis; coronary collaterals; cerebral collaterals; arteriovenous malformations; ischemic limb angiogenesis; Osler-Webber Syndrome; plaque neovascularization; telangiectasia; hemophiliac joints; angiofibroma; fibromuscular dysplasia; wound granulation; Crohn's disease; and atherosclerosis.

For example, within one aspect of the present invention methods are provided for treating hypertrophic scars and keloids, comprising the step of administering a polynucleotide, polypeptide, antagonist and/or agonist of the invention to a hypertrophic scar or keloid.

Within one embodiment of the present invention polynucleotides, polypeptides, antagonists and/or agonists of the invention are directly injected into a hypertrophic scar or keloid, in order to prevent the progression of these lesions. This therapy is of particular value in the prophylactic treatment of conditions which are known to result in the development of hypertrophic scars and keloids (e.g., burns), and is preferably initiated after the proliferative phase has had time to progress (approximately 14 days after the initial injury), but before hypertrophic scar or keloid development. As noted above, the present invention also provides methods for treating neovascular diseases of the eye, including for example, corneal neovascularization, neovascular glaucoma, proliferative diabetic retinopathy, retrolental fibroplasia and macular degeneration.

Moreover, Ocular disorders associated with neovascularization which can be treated with the polynucleotides and polypeptides of the present invention (including agonists and/or antagonists) include, but are not limited to: neovascular glaucoma, diabetic retinopathy, retinoblastoma, retrolental fibroplasia, uveitis, retinopathy of prematurity macular degeneration, corneal graft neovascularization, as well as other eye inflammatory diseases, ocular tumors and diseases associated with choroidal or iris neovascularization. See, e.g., reviews by Waltman et al., *Am. J. Ophthal.* 85:704-710 (1978) and Gartner et al., *Surv. Ophthal.* 22:291-312 (1978).

Thus, within one aspect of the present invention methods are provided for treating neovascular diseases of the eye such as corneal neovascularization (including corneal graft neovascularization), comprising the step of administering to a patient a therapeutically effective amount of a compound (as described above) to the cornea, such that the formation of blood vessels is inhibited. Briefly, the cornea is a tissue which normally lacks blood vessels. In certain pathological conditions however, capillaries may extend into the cornea from the pericorneal vascular plexus of the limbus. When the cornea becomes vascularized, it also becomes clouded, resulting in a decline in the patient's visual acuity. Visual loss may become complete if the cornea completely opacitates. A wide variety of disorders can result in corneal neovascularization, including for example, corneal infections (e.g., trachoma, herpes simplex keratitis, leishmaniasis and onchocerciasis), immunological processes (e.g., graft rejection and Stevens-Johnson's syndrome), alkali burns, trauma, inflammation (of any cause), toxic and nutritional deficiency states, and as a complication of wearing contact lenses.

Within particularly preferred embodiments of the invention, may be prepared for topical administration in saline (combined with any of the preservatives and antimicrobial agents commonly used in ocular preparations), and administered in eyedrop form. The solution or suspension may be prepared in its pure form and administered several times daily. Alternatively, anti-angiogenic compositions, prepared as described above, may also be administered directly to the cornea. Within preferred embodiments, the anti-angiogenic composition is prepared with a muco-adhesive polymer which binds to cornea. Within further embodiments, the anti-angiogenic factors or anti-angiogenic compositions may be utilized as an adjunct to conventional steroid therapy. Topical therapy may also be useful prophylactically in corneal lesions which are known to have a high probability of inducing an angiogenic response (such as chemical burns). In these instances the treatment, likely in combination with steroids, may be instituted immediately to help prevent subsequent complications.

Within other embodiments, the compounds described above may be injected directly into the corneal stroma by an ophthalmologist under microscopic guidance. The preferred site of injection may vary with the morphology of the individual lesion, but the goal of the administration would be to place the composition at the advancing front of the vasculature (i.e., interspersed between the blood vessels and the normal cornea). In most cases this would involve perilimbic corneal injection to "protect" the cornea from the advancing blood vessels. This method may also be utilized shortly after a corneal insult in order to prophylactically prevent corneal neovascularization. In this situation the material could be injected in the perilimbic cornea interspersed between the corneal lesion and its undesired potential limbic blood supply. Such methods may also be utilized in a similar fashion to prevent capillary invasion of transplanted corneas. In a sustained-release form injections might only be required 2-3 times per year. A steroid could also be added to the injection solution to reduce inflammation resulting from the injection itself.

Within another aspect of the present invention, methods are provided for treating neovascular glaucoma, comprising the step of administering to a patient a therapeutically effective amount of a polynucleotide, polypeptide, antagonist and/or agonist to the eye, such that the formation of blood vessels is inhibited. In one embodiment, the compound may be administered topically to the eye in order to treat early forms of neovascular glaucoma. Within other embodiments, the compound may be implanted by injection into the region of the anterior chamber angle. Within other embodiments, the compound may also be placed in any location such that the compound is continuously released into the aqueous humor. Within another aspect of the present invention, methods are provided for treating proliferative diabetic retinopathy, comprising the step of administering to a patient a therapeutically effective amount of a polynucleotide, polypeptide, antagonist and/or agonist to the eyes, such that the formation of blood vessels is inhibited.

Within particularly preferred embodiments of the invention, proliferative diabetic retinopathy may be treated by injection into the aqueous humor or the vitreous, in order to increase the local concentration of the polynucleotide, polypeptide, antagonist and/or agonist in the retina. Preferably, this treatment should be initiated prior to the acquisition of severe disease requiring photocoagulation.

Within another aspect of the present invention, methods are provided for treating retrolental fibroplasia, comprising the step of administering to a patient a therapeutically effective amount of a polynucleotide, polypeptide, antagonist and/or agonist to the eye, such that the formation of blood vessels is inhibited. The compound may be administered topically, via intravitreous injection and/or via intraocular implants.

Additionally, disorders which can be treated with the polynucleotides, polypeptides, agonists and/or agonists include, but are not limited to, hemangioma, arthritis, psoriasis, angiofibroma, atherosclerotic plaques, delayed wound healing, granulations, hemophilic joints, hypertrophic scars, nonunion fractures, Osler-Weber syndrome, pyogenic granuloma, scleroderma, trachoma, and vascular adhesions.

Moreover, disorders and/or states, which can be treated, prevented, diagnosed, and/or prognosed with the polynucleotides, polypeptides, agonists and/or agonists of the invention include, but are not limited to, solid tumors, blood born tumors such as leukemias, tumor metastasis, Kaposi's sarcoma, benign tumors, for example hemangiomas, acoustic neuromas, neurofibromas, trachomas, and pyogenic granulomas, rheumatoid arthritis, psoriasis, ocular angiogenic diseases, for example, diabetic retinopathy, retinopathy of prematurity, macular degeneration, corneal graft rejection, neovascular glaucoma, retrolental fibroplasia, rubeosis, retinoblastoma, and uvietis, delayed wound healing, endometriosis, vascluogenesis, granulations, hypertrophic scars (keloids), nonunion fractures, scleroderma, trachoma, vascular adhesions, myocardial angiogenesis, coronary collaterals, cerebral collaterals, arteriovenous malformations, ischemic limb angiogenesis, Osler-Webber Syndrome, plaque neovascularization, telangiectasia, hemophiliac joints, angiofibroma fibromuscular dysplasia, wound granulation, Crohn's disease, atherosclerosis, birth control agent by preventing vascularization required for embryo implantation controlling menstruation, diseases that have angiogenesis as a pathologic consequence such as cat scratch disease (Rochele minalia quintosa), ulcers (*Helicobacter pylori*), Bartonellosis and bacillary angiomatosis.

In one aspect of the birth control method, an amount of the compound sufficient to block embryo implantation is administered before or after intercourse and fertilization have occurred, thus providing an effective method of birth control, possibly a "morning after" method. Polynucleotides, polypeptides, agonists and/or agonists may also be used in controlling menstruation or administered as either a peritoneal lavage fluid or for peritoneal implantation in the treatment of endometriosis.

Polynucleotides, polypeptides, agonists and/or agonists of the present invention may be incorporated into surgical sutures in order to prevent stitch granulomas.

Polynucleotides, polypeptides, agonists and/or agonists may be utilized in a wide variety of surgical procedures. For example, within one aspect of the present invention a compositions (in the form of, for example, a spray or film) may be utilized to coat or spray an area prior to removal of a tumor, in order to isolate normal surrounding tissues from malignant tissue, and/or to prevent the spread of disease to surrounding tissues. Within other aspects of the present invention, compositions (e.g., in the form of a spray) may be delivered via endoscopic procedures in order to coat tumors, or inhibit angiogenesis in a desired locale. Within yet other aspects of the present invention, surgical meshes which have been coated with anti-angiogenic compositions of the present invention may be utilized in any procedure wherein a surgical mesh might be utilized. For example, within one embodiment of the invention a surgical mesh laden with an anti-angiogenic composition may be utilized during abdominal cancer resection surgery (e.g., subsequent to colon resection) in order to provide support to the structure, and to release an amount of the anti-angiogenic factor.

Within further aspects of the present invention, methods are provided for treating tumor excision sites, comprising administering a polynucleotide, polypeptide, agonist and/or agonist to the resection margins of a tumor subsequent to excision, such that the local recurrence of cancer and the formation of new blood vessels at the site is inhibited. Within one embodiment of the invention, the anti-angiogenic compound is administered directly to the tumor excision site (e.g., applied by swabbing, brushing or otherwise coating the resection margins of the tumor with the anti-angiogenic compound). Alternatively, the anti-angiogenic compounds may be incorporated into known surgical pastes prior to administration. Within particularly preferred embodiments of the invention, the anti-angiogenic compounds are applied after hepatic resections for malignancy, and after neurosurgical operations.

Within one aspect of the present invention, polynucleotides, polypeptides, agonists and/or agonists may be administered to the resection margin of a wide variety of tumors, including for example, breast, colon, brain and hepatic tumors. For example, within one embodiment of the invention, anti-angiogenic compounds may be administered to the site of a neurological tumor subsequent to excision, such that the formation of new blood vessels at the site are inhibited.

The polynucleotides, polypeptides, agonists and/or agonists of the present invention may also be administered along with other anti-angiogenic factors. Representative examples of other anti-angiogenic factors include: Anti-Invasive Factor, retinoic acid and derivatives thereof, paclitaxel, Suramin, Tissue Inhibitor of Metalloproteinase-1, Tissue Inhibitor of Metalloproteinase-2, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include platelet factor 4; protamine sulphate; sulphated chitin derivatives (prepared from queen crab shells), (Murata et al., Cancer Res. 51:22-26, 1991); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., J. Bio. Chem. 267:17321-17326, 1992); Chymostatin (Tomkinson et al., Biochem J. 286:475-480, 1992); Cyclodextrin Tetradecasulfate; Eponemycin; Camptothecin; Fumagillin (Ingber et al., Nature 348:555-557, 1990); Gold Sodium Thiomalate ("GST"; Matsubara and Ziff, J. Clin. Invest. 79:1440-1446, 1987); anticollagenase-serum; alpha2-antiplasmin (Holmes et al., J. Biol. Chem. 262(4):1659-1664, 1987); Bisantrene (National Cancer Institute); Lobenzarit disodium (N-(2)-carboxyphenyl-4-chloroanthronilic acid disodium or "CCA"; Takeuchi et al., Agents Actions 36:312-316, 1992); Thalidomide; Angostatic steroid; AGM-1470; carboxynaminolmidazole; and metalloproteinase inhibitors such as BB94.

Diseases at the Cellular Level

Diseases associated with increased cell survival or the inhibition of apoptosis that could be treated, prevented, diagnosed, and/or prognosed using polynucleotides or polypeptides, as well as antagonists or agonists of the present invention, include cancers (such as follicular lymphomas, carcinomas with p53 mutations, and hormone-dependent tumors, including, but not limited to colon cancer, cardiac tumors, pancreatic cancer, melanoma, retinoblastoma, glioblastoma, lung cancer, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, breast cancer, prostate cancer, Kaposi's sarcoma and ovarian cancer); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) and viral infections (such as herpes viruses, pox viruses and adenoviruses), inflammation, graft v. host disease, acute graft rejection, and chronic graft rejection.

In preferred embodiments, polynucleotides, polypeptides, and/or antagonists of the invention are used to inhibit growth, progression, and/or metasis of cancers, in particular those listed above.

Additional diseases or conditions associated with increased cell survival that could be treated or detected by polynucleotides or polypeptides, or agonists or antagonists of the present invention include, but are not limited to, progression, and/or metastases of malignancies and related disorders such as leukemia (including acute leukemias (e.g., acute lymphocytic leukemia, acute myelocytic leukemia (including myeloblastic, promyelocytic, myelomonocytic, monocytic, and erythroleukemia)) and chronic leukemias (e.g., chronic myelocytic (granulocytic) leukemia and chronic lymphocytic leukemia)), polycythemia vera, lymphomas (e.g., Hodgkin's disease and non-Hodgkin's disease), multiple myeloma, Waldenstrom's macroglobulinemia, heavy chain disease, and solid tumors including, but not limited to, sarcomas and carcinomas such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular tumor, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, menangioma, melanoma, neuroblastoma, and retinoblastoma.

Diseases associated with increased apoptosis that could be treated, prevented, diagnosed, and/or prognesed using polynucleotides or polypeptides, as well as agonists or antagonists of the present invention, include, but are not limited to, AIDS; neurodegenerative disorders (such as Alzheimer's disease, Parkinson's disease, Amyotrophic lateral sclerosis, Retinitis pigmentosa, Cerebellar degeneration and brain tumor or prior associated disease); autoimmune disorders (such as, multiple sclerosis, Sjogren's syndrome, Hashimoto's thyroiditis, biliary cirrhosis, Behcet's disease, Crohn's disease, polymyositis, systemic lupus erythematosus and immune-related glomerulonephritis and rheumatoid arthritis) myelodysplastic syndromes (such as aplastic anemia), graft v. host disease, ischemic injury (such as that caused by myocardial infarction, stroke and reperfusion injury), liver injury (e.g., hepatitis related liver injury, ischemia/reperfusion injury, cholestosis (bile duct injury) and liver cancer); toxin-induced liver disease (such as that caused by alcohol), septic shock, cachexia and anorexia.

Wound Healing and Epithelial Cell Proliferation

In accordance with yet a further aspect of the present invention, there is provided a process for utilizing polynucleotides or polypeptides, as well as agonists or antagonists of the present invention, for therapeutic purposes, for example, to stimulate epithelial cell proliferation and basal keratinocytes for the purpose of wound healing, and to stimulate hair follicle production and healing of dermal wounds. Polynucleotides or polypeptides, as well as agonists or antagonists of the present invention, may be clinically useful in stimulating wound healing including surgical wounds, excisional wounds, deep wounds involving damage of the dermis and epidermis, eye tissue wounds, dental tissue wounds, oral cavity wounds, diabetic ulcers, dermal ulcers, cubitus ulcers, arterial ulcers, venous stasis ulcers, burns resulting from heat exposure or chemicals, and other abnormal wound healing conditions such as uremia, malnutrition, vitamin deficiencies and complications associated with systemic treatment with steroids, radiation therapy and antineoplastic drugs and antimetabolites. Polynucleotides or polypeptides, as well as agonists or antagonists of the present invention, could be used to promote dermal reestablishment subsequent to dermal loss.

Polynucleotides or polypeptides, as well as agonists or antagonists of the present invention, could be used to increase the adherence of skin grafts to a wound bed and to stimulate re-epithelialization from the wound bed. The following are types of grafts that polynucleotides or polypeptides, agonists or antagonists of the present invention, could be used to increase adherence to a wound bed: autografts, artificial skin, allografts, autodermic graft, autoepdermic grafts, avacular grafts, Blair-Brown grafts, bone graft, brephoplastic grafts, cutis graft, delayed graft, dermic graft, epidermic graft, fascia graft, full thickness graft, heterologous graft, xenograft, homologous graft, hyperplastic graft, lamellar graft, mesh graft, mucosal graft, Ollier-Thiersch graft, omenpal graft, patch graft, pedicle graft, penetrating graft, split skin graft, thick split graft. Polynucleotides or polypeptides, as well as agonists or antagonists of the present invention, can be used to promote skin strength and to improve the appearance of aged skin.

It is believed that polynucleotides or polypeptides, as well as agonists or antagonists of the present invention, will also produce changes in hepatocyte proliferation, and epithelial cell proliferation in the lung, breast, pancreas, stomach, small intestine, and large intestine. Polynucleotides or polypeptides, as well as agonists or antagonists of the present invention, could promote proliferation of epithelial cells such as sebocytes, hair follicles, hepatocytes, type II pneumocytes, mucin-producing goblet cells, and other epithelial cells and their progenitors contained within the skin, lung, liver, and gastrointestinal tract. Polynucleotides or polypeptides, agonists or antagonists of the present invention, may promote proliferation of endothelial cells, keratinocytes, and basal keratinocytes.

Polynucleotides or polypeptides, as well as agonists or antagonists of the present invention, could also be used to reduce the side effects of gut toxicity that result from radiation, chemotherapy treatments or viral infections. Polynucleotides or polypeptides, as well as agonists or antagonists of the present invention, may have a cytoprotective effect on the small intestine mucosa. Polynucleotides or polypeptides, as well as agonists or antagonists of the present invention, may also stimulate healing of mucositis (mouth ulcers) that result from chemotherapy and viral infections.

Polynucleotides or polypeptides, as well as agonists or antagonists of the present invention, could further be used in full regeneration of skin in full and partial thickness skin defects, including burns, (i.e., repopulation of hair follicles, sweat glands, and sebaceous glands), treatment of other skin defects such as psoriasis. Polynucleotides or polypeptides, as well as agonists or antagonists of the present invention, could be used to treat epidermolysis bullosa, a defect in adherence of the epidermis to the underlying dermis which results in frequent, open and painful blisters by accelerating reepithelialization of these lesions. Polynucleotides or polypeptides, as well as agonists or antagonists of the present invention, could also be used to treat gastric and doudenal ulcers and help heal by scar formation of the mucosal lining and regeneration of glandular mucosa and duodenal mucosal lining more rapidly. Inflammatory bowel diseases, such as Crohn's disease and ulcerative colitis, are diseases which result in destruction of the mucosal surface of the small or large intestine, respectively. Thus, polynucleotides or polypeptides, as well as agonists or antagonists of the present invention, could be used to promote the resurfacing of the mucosal surface to aid more rapid healing and to prevent progression of inflammatory bowel disease. Treatment with polynucleotides or polypeptides, agonists or antagonists of the present invention, is expected to have a significant effect on the production of mucus throughout the gastrointestinal tract and could be used to protect the intestinal mucosa from injurious substances that are ingested or following surgery. Polynucleotides or polypeptides, as well as agonists or antagonists of the present invention, could be used to treat diseases associate with the under expression.

Moreover, polynucleotides or polypeptides, as well as agonists or antagonists of the present invention, could be used to prevent and heal damage to the lungs due to various pathological states. Polynucleotides or polypeptides, as well as agonists or antagonists of the present invention, which could stimulate proliferation and differentiation and promote the repair of alveoli and brochiolar epithelium to prevent or treat acute or chronic lung damage. For example, emphysema, which results in the progressive loss of aveoli, and inhalation injuries, i.e., resulting from smoke inhalation and burns, that cause necrosis of the bronchiolar epithelium and alveoli could be effectively treated using polynucleotides or polypeptides, agonists or antagonists of the present invention. Also, polynucleotides or polypeptides, as well as agonists or antagonists of the present invention, could be used to stimulate the proliferation of and differentiation of type II pneumocytes, which may help treat or prevent disease such as hyaline membrane diseases, such as infant respiratory distress syndrome and bronchopulmonary displasia, in premature infants.

Polynucleotides or polypeptides, as well as agonists or antagonists of the present invention, could stimulate the proliferation and differentiation of hepatocytes and, thus, could be used to alleviate or treat liver diseases and pathologies such as fulminant liver failure caused by cirrhosis, liver damage caused by viral hepatitis and toxic substances (i.e., acetaminophen, carbon tetrachloride and other hepatotoxins known in the art).

In addition, polynucleotides or polypeptides, as well as agonists or antagonists of the present invention, could be used treat or prevent the onset of diabetes mellitus. In patients with newly diagnosed Types I and II diabetes, where some islet cell function remains, polynucleotides or polypeptides, as well as agonists or antagonists of the present invention, could be used to maintain the islet function so as to alleviate, delay or prevent permanent manifestation of the disease. Also, polynucleotides or polypeptides, as well as agonists or antagonists of the present invention, could be used as an auxiliary in islet cell transplantation to improve or promote islet cell function.

Neural Activity and Neurological Diseases

The polynucleotides, polypeptides and agonists or antagonists of the invention may be used for the diagnosis and/or treatment of diseases, disorders, damage or injury of the brain and/or nervous system. Nervous system disorders that can be treated with the compositions of the invention (e.g., polypeptides, polynucleotides, and/or agonists or antagonists), include, but are not limited to, nervous system injuries, and diseases or disorders which result in either a disconnection of axons, a diminution or degeneration of neurons, or demyelination. Nervous system lesions which may be treated in a patient (including human and non-human mammalian patients) according to the methods of the invention, include but are not limited to, the following lesions of either the central (including spinal cord, brain) or peripheral nervous systems: (1) ischemic lesions, in which a lack of oxygen in a portion of the nervous system results in neuronal injury or death, including cerebral infarction or ischemia, or spinal cord infarction or ischemia; (2) traumatic lesions, including lesions caused by physical injury or associated with surgery, for example, lesions which sever a portion of the nervous system, or compression injuries; (3) malignant lesions, in which a portion of the nervous system is destroyed or injured by malignant tissue which is either a nervous system associated malignancy or a malignancy derived from non-nervous system tissue; (4) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, or syphilis; (5) degenerative lesions, in which a portion of the nervous system is destroyed or injured as a result of a degenerative process including but not limited to, degeneration associated with Parkinson's disease, Alzheimer's disease, Huntington's chorea, or amyotrophic lateral sclerosis (ALS); (6) lesions associated with nutritional diseases or disorders, in which a portion of the nervous system is destroyed or injured by a nutritional disorder or disorder of metabolism including, but not limited to, vitamin B12 deficiency, folic acid deficiency, Wernicke disease, tobacco-alcohol amblyopia, Marchiafava-Bignami disease (primary degeneration of the corpus callosum), and alcoholic cerebellar degeneration; (7) neurological lesions associated with systemic diseases including, but not limited to, diabetes (diabetic neuropathy, Bell's palsy), systemic lupus erythematosus, carcinoma, or sarcoidosis; (8) lesions caused by toxic substances including alcohol, lead, or particular neurotoxins; and (9) demyelinated lesions in which a portion of the nervous system is destroyed or injured by a demyelinating disease including, but not limited to, multiple sclerosis, human immunodeficiency virus-associated myelopathy, transverse myelopathy or various etiologies, progressive multifocal leukoencephalopathy, and central pontine myelinolysis.

In one embodiment, the polypeptides, polynucleotides, or agonists or antagonists of the invention are used to protect neural cells from the damaging effects of hypoxia. In a further preferred embodiment, the polypeptides, polynucleotides, or agonists or antagonists of the invention are used to protect neural cells from the damaging effects of cerebral hypoxia. According to this embodiment, the compositions of the invention are used to treat or prevent neural cell injury associated with cerebral hypoxia. In one non-exclusive aspect of this embodiment, the polypeptides, polynucleotides, or agonists or antagonists of the invention, are used to treat or prevent neural cell injury associated with cerebral ischemia. In another non-exclusive aspect of this embodiment, the polypeptides, polynucleotides, or agonists or antagonists of the invention are used to treat or prevent neural cell injury associated with cerebral infarction.

In another preferred embodiment, the polypeptides, polynucleotides, or agonists or antagonists of the invention are used to treat or prevent neural cell injury associated with a stroke. In a specific embodiment, the polypeptides, polynucleotides, or agonists or antagonists of the invention are used to treat or prevent cerebral neural cell injury associated with a stroke.

In another preferred embodiment, the polypeptides, polynucleotides, or agonists or antagonists of the invention are used to treat or prevent neural cell injury associated with a heart attack. In a specific embodiment, the polypeptides, polynucleotides, or agonists or antagonists of the invention are used to treat or prevent cerebral neural cell injury associated with a heart attack.

The compositions of the invention which are useful for treating or preventing a nervous system disorder may be selected by testing for biological activity in promoting the survival or differentiation of neurons. For example, and not by way of limitation, compositions of the invention which elicit any of the following effects may be useful according to the invention: (1) increased survival time of neurons in culture either in the presence or absence of hypoxia or hypoxic conditions; (2) increased sprouting of neurons in culture or in vivo; (3) increased production of a neuron-associated molecule in culture or in vivo, e.g., choline acetyltransferase or acetylcholinesterase with respect to motor neurons; or (4) decreased symptoms of neuron dysfunction in vivo. Such effects may be measured by any method known in the art. In preferred, non-limiting embodiments, increased survival of neurons may routinely be measured using a method set forth herein or otherwise known in the art, such as, for example, in Zhang et al., *Proc Natl Acad Sci USA* 97:3637-42 (2000) or in Arakawa et al., *J. Neurosci.*, 10:3507-15 (1990); increased sprouting of neurons may be detected by methods known in the art, such as, for example, the methods set forth in Pestronk et al., *Exp. Neurol.*, 70:65-82 (1980), or Brown et al., *Ann. Rev. Neurosci.*, 4:17-42 (1981); increased production of neuron-associated molecules may be measured by bioassay, enzymatic assay, antibody binding, Northern blot assay, etc., using techniques known in the art and depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include, but are not limited to, disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including, but not limited to, progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

Further, polypeptides or polynucleotides of the invention may play a role in neuronal survival; synapse formation; conductance; neural differentiation, etc. Thus, compositions of the invention (including polynucleotides, polypeptides, and agonists or antagonists) may be used to diagnose and/or treat or prevent diseases or disorders associated with these roles, including, but not limited to, learning and/or cognition disorders. The compositions of the invention may also be useful in the treatment or prevention of neurodegenerative disease states and/or behavioural disorders. Such neurodegenerative disease states and/or behavioral disorders include, but are not limited to, Alzheimer's Disease, Parkinson's Disease, Huntington's Disease, Tourette Syndrome, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, compositions of the invention may also play a role in the treatment, prevention and/or detection of developmental disorders associated with the developing embryo, or sexually-linked disorders.

Additionally, polypeptides, polynucleotides and/or agonists or antagonists of the invention, may be useful in protecting neural cells from diseases, damage, disorders, or injury, associated with cerebrovascular disorders including, but not limited to, carotid artery diseases (e.g., carotid artery thrombosis, carotid stenosis, or Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis (e.g., carotid artery thrombosis, sinus thrombosis, or Wallenberg's Syndrome), cerebral hemorrhage (e.g., epidural or subdural hematoma, or subarachnoid hemorrhage), cerebral infarction, cerebral ischemia (e.g., transient cerebral ischemia, Subdlavian Steal Syndrome, or vertebrobasilar insufficiency), vascular dementia (e.g., multi-infarct), leukomalacia, periventricular, and vascular headache (e.g., cluster headache or migraines).

In accordance with yet a further aspect of the present invention, there is provided a process for utilizing polynucleotides or polypeptides, as well as agonists or antagonists of the present invention, for therapeutic purposes, for example, to stimulate neurological cell proliferation and/or differentiation. Therefore, polynucleotides, polypeptides, agonists and/or antagonists of the invention may be used to treat and/or detect neurologic diseases. Moreover, polynucleotides or polypeptides, or agonists or antagonists of the invention, can be used as a marker or detector of a particular nervous system disease or disorder.

Examples of neurologic diseases which can be treated or detected with polynucleotides, polypeptides, agonists, and/or antagonists of the present invention include brain diseases, such as metabolic brain diseases which includes phenylketonuria such as maternal phenylketonuria, pyruvate carboxylase deficiency, pyruvate dehydrogenase complex deficiency, Wernicke's Encephalopathy, brain edema, brain neoplasms such as cerebellar neoplasms which include infratentorial neoplasms, cerebral ventricle neoplasms such as choroid plexus neoplasms, hypothalamic neoplasms, supratentorial neoplasms, canavan disease, cerebellar diseases such as cerebellar ataxia which include spinocerebellar degeneration such as ataxia telangiectasia, cerebellar dyssynergia, Friederich's Ataxia, Machado-Joseph Disease, olivopontocerebellar atrophy, cerebellar neoplasms such as infratentorial neoplasms, diffuse cerebral sclerosis such as encephalitis periaxialis, globoid cell leukodystrophy, metachromatic leukodystrophy and subacute sclerosing panencephalitis.

Additional neurologic diseases which can be treated or detected with polynucleotides, polypeptides, agonists, and/or antagonists of the present invention include cerebrovascular disorders (such as carotid artery diseases which include carotid artery thrombosis, carotid stenosis and Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis such as carotid artery thrombosis, sinus thrombosis and Wallenberg's Syndrome, cerebral hemorrhage such as epidural hematoma, subdural hematoma and subarachnoid hemorrhage, cerebral infarction, cerebral ischemia such as transient cerebral ischemia, Subclavian Steal Syndrome and vertebrobasilar insufficiency, vascular dementia such as multi-infarct dementia, periventricular leukomalacia, vascular headache such as cluster headache and migraine.

Additional neurologic diseases which can be treated or detected with polynucleotides, polypeptides, agonists, and/or antagonists of the present invention include dementia such as AIDS Dementia Complex, presenile dementia such as Alzheimer's Disease and Creutzfeldt-Jakob Syndrome, senile dementia such as Alzheimer's Disease and progressive supranuclear palsy, vascular dementia such as multi-infarct dementia, encephalitis which include encephalitis periaxialis, viral encephalitis such as epidemic encephalitis, Japanese Encephalitis, St. Louis Encephalitis, tick-borne encephalitis and West Nile Fever, acute disseminated encephalomyelitis, meningoencephalitis such as uveomeningoencephalitic syndrome, Postencephalitic Parkinson Disease and subacute sclerosing panencephalitis, encephalomalacia such as periventricular leukomalacia, epilepsy such as generalized epilepsy which includes infantile spasms, absence epilepsy, myoclonic epilepsy which includes MERRF Syndrome, tonic-clonic epilepsy, partial epilepsy such as complex partial epilepsy, frontal lobe epilepsy and temporal lobe epilepsy, post-traumatic epilepsy, status epilepticus such as Epilepsia Partialis Continua, and Hallervorden-Spatz Syndrome.

Additional neurologic diseases which can be treated or detected with polynucleotides, polypeptides, agonists, and/or antagonists of the present invention include hydrocephalus such as Dandy-Walker Syndrome and normal pressure hydrocephalus, hypothalamic diseases such as hypothalamic neoplasms, cerebral malaria, narcolepsy which includes cataplexy, bulbar poliomyelitis, cerebri pseudotumor, Rett Syndrome, Reye's Syndrome, thalamic diseases, cerebral toxoplasmosis, intracranial tuberculoma and Zellweger Syndrome, central nervous system infections such as AIDS Dementia Complex, Brain Abscess, subdural empyema, encephalomyelitis such as Equine Encephalomyelitis, Venezuelan Equine Encephalomyelitis, Necrotizing Hemorrhagic Encephalomyelitis, Visna, and cerebral malaria.

Additional neurologic diseases which can be treated or detected with polynucleotides, polypeptides, agonists, and/or antagonists of the present invention include meningitis such as arachnoiditis, aseptic meningitis such as viral meningtitis which includes lymphocytic choriomeningitis, Bacterial meningtitis which includes *Haemophilus* Meningtitis, *Listeria* Meningtitis, Meningococcal Meningtitis such as Waterhouse-Friderichsen Syndrome, Pneumococcal Meningtitis and meningeal tuberculosis, fungal meningitis such as Cryptococcal Meningtitis, subdural effusion, meningoencephalitis such as uvemeningoencephalitic syndrome, myelitis such as transverse myelitis, neurosyphilis such as tabes dorsalis, poliomyelitis which includes bulbar poliomyelitis and post-poliomyelitis syndrome, prion diseases (such as Creutzfeldt-Jakob Syndrome, Bovine Spongiform Encephalopathy, Gerstmann-Straussler Syndrome, Kuru, Scrapie), and cerebral toxoplasmosis.

Additional neurologic diseases which can be treated or detected with polynucleotides, polypeptides, agonists, and/or antagonists of the present invention include central nervous system neoplasms such as brain neoplasms that include cerebellar neoplasms such as infratentorial neoplasms, cerebral ventricle neoplasms such as choroid plexus neoplasms, hypothalamic neoplasms and supratentorial neoplasms, meningeal neoplasms, spinal cord neoplasms which include epidural neoplasms, demyelinating diseases such as Canavan Diseases, diffuse cerebral sceloris which includes adrenoleukodystrophy, encephalitis periaxialis, globoid cell leukodystrophy, diffuse cerebral sclerosis such as metachromatic leukodystrophy, allergic encephalomyelitis, necrotizing hemorrhagic encephalomyelitis, progressive multifocal leukoencephalopathy, multiple sclerosis, central pontine myelinolysis, transverse myelitis, neuromyelitis optica, Scrapie, Swayback, Chronic Fatigue Syndrome, Visna, High Pressure Nervous Syndrome, Meningism, spinal cord diseases such as amyotonia congenita, amyotrophic lateral sclerosis, spinal muscular atrophy such as Werdnig-Hoffmann Disease, spinal cord compression, spinal cord neoplasms such as epidural neoplasms, syringomyelia, Tabes Dorsalis, Stiff-Man Syndrome, mental retardation such as Angelman Syndrome, Cri-du-Chat Syndrome, De Lange's Syndrome, Down Syndrome, Gangliosidoses such as gangliosidoses G(M1), Sandhoff Disease, Tay-Sachs Disease, Hartnup Disease, homocystinuria, Laurence-Moon-Biedl Syndrome, Lesch-Nyhan Syndrome, Maple Syrup Urine Disease, mucolipidosis such as fucosidosis, neuronal ceroid-lipofuscinosis, oculocerebrorenal syndrome, phenylketonuria such as maternal phenylketonuria, Prader-Willi Syndrome, Rett Syndrome, Rubinstein-Taybi Syndrome, Tuberous Sclerosis, WAGR Syndrome, nervous system abnormalities such as holoprosencephaly, neural tube defects such as anencephaly which includes hydrangencephaly, Arnold-Chairi Deformity, encephalocele, meningocele, meningomyelocele, spinal dysraphism such as spina bifida cystica and spina bifida occulta.

Additional neurologic diseases which can be treated or detected with polynucleotides, polypeptides, agonists, and/or antagonists of the present invention include hereditary motor and sensory neuropathies which include Charcot-Marie Disease, Hereditary optic atrophy, Refsum's Disease, hereditary spastic paraplegia, Werdnig-Hoffmann Disease, Hereditary Sensory and Autonomic Neuropathies such as Congenital Analgesia and Familial Dysautonomia, Neurologic manifestations (such as agnosia that include Gerstmann's Syndrome, Amnesia such as retrograde amnesia, apraxia, neurogenic bladder, cataplexy, communicative disorders such as hearing disorders that includes deafness, partial hearing loss, loudness recruitment and tinnitus, language disorders such as aphasia which include agraphia, anomia, broca aphasia, and Wernicke Aphasia, Dyslexia such as Acquired Dyslexia, language development disorders, speech disorders such as aphasia which includes anomia, broca aphasia and Wernicke Aphasia, articulation disorders, communicative disorders such as speech disorders which include dysarthria, echolalia, mutism and stuttering, voice disorders such as aphonia and hoarseness, decerebrate state, delirium, fasciculation, hallucinations, meningism, movement disorders such as angelman syndrome, ataxia, athetosis, chorea, dystonia, hypokinesia, muscle hypotonia, myoclonus, tic, torticollis and tremor, muscle hypertonia such as muscle rigidity such as stiff-man syndrome, muscle spasticity, paralysis such as facial paralysis which includes Herpes Zoster Oticus, Gastroparesis, Hemiplegia, ophthalmoplegia such as diplopia, Duane's Syndrome, Horner's Syndrome, Chronic progressive external ophthalmoplegia such as Kearns Syndrome, Bulbar Paralysis, Tropical Spastic Paraparesis, Paraplegia such as Brown-Sequard Syndrome, quadriplegia, respiratory paralysis and vocal cord paralysis, paresis, phantom limb, taste disorders such as ageusia and dysgeusia, vision disorders such as amblyopia, blindness, color vision defects, diplopia, hemianopsia, scotoma and subnormal vision, sleep disorders such as hypersomnia which includes Kleine-Levin Syndrome, insomnia, and somnambulism, spasm such as trismus, unconsciousness such as coma, persistent vegetative state and syncope and vertigo, neuromuscular diseases such as amyotonia congenita, amyotrophic lateral sclerosis, Lambert-Eaton Myasthenic Syndrome, motor neuron disease, muscular atrophy such as spinal muscular atrophy, Charcot-Marie Disease and Werdnig-Hoffmann Disease, Postpoliomyelitis Syndrome, Muscular Dystrophy, Myasthenia Gravis, Myotonia Atrophica, Myotonia Confenita, Nemaline Myopathy, Familial Periodic Paralysis, Multiplex Paramyloclonus, Tropical Spastic Paraparesis and Stiff-Man Syndrome, peripheral nervous system diseases such as acrodynia, amyloid neuropathies, autonomic nervous system diseases such as Adie's Syndrome, Barre-Lieou Syndrome, Familial Dysautonomia, Horner's Syndrome, Reflex Sympathetic Dystrophy and Shy-Drager Syndrome, Cranial Nerve Diseases such as Acoustic Nerve Diseases such as Acoustic Neuroma which includes Neurofibromatosis 2, Facial Nerve Diseases such as Facial Neuralgia, Melkersson-Rosenthal Syndrome, ocular motility disorders which includes amblyopia, nystagmus, oculomotor nerve paralysis, ophthalmoplegia such as Duane's Syndrome, Horner's Syndrome, Chronic Progressive External Ophthalmoplegia which includes Kearns Syndrome, Strabismus such as Esotropia and Exotropia, Oculomotor Nerve Paralysis, Optic Nerve Diseases such as Optic Atrophy which includes Hereditary Optic Atrophy, Optic Disk Drusen, Optic Neuritis such as Neuromyelitis Optica, Papilledema, Trigeminal Neuralgia, Vocal Cord Paralysis, Demyelinating Diseases such as Neuromyelitis Optica and Swayback, and Diabetic neuropathies such as diabetic foot.

Additional neurologic diseases which can be treated or detected with polynucleotides, polypeptides, agonists, and/or antagonists of the present invention include nerve compression syndromes such as carpal tunnel syndrome, tarsal tunnel syndrome, thoracic outlet syndrome such as cervical rib syndrome, ulnar nerve compression syndrome, neuralgia such as causalgia, cervico-brachial neuralgia, facial neuralgia and trigeminal neuralgia, neuritis such as experimental allergic neuritis, optic neuritis, polyneuritis, polyradiculoneuritis and radiculities such as polyradiculitis, hereditary motor and sensory neuropathies such as Charcot-Marie Disease, Hereditary Optic Atrophy, Refsum's Disease, Hereditary Spastic Paraplegia and Werdnig-Hoffmann Disease, Hereditary Sensory and Autonomic Neuropathies which include Congenital Analgesia and Familial Dysautonomia, POEMS Syndrome, Sciatica, Gustatory Sweating and Tetany).

Endocrine Disorders

Polynucleotides or polypeptides, or agonists or antagonists of the present invention, may be used to treat, prevent, diagnose, and/or prognose disorders and/or diseases related to hormone imbalance, and/or disorders or diseases of the endocrine system.

Hormones secreted by the glands of the endocrine system control physical growth, sexual function, metabolism, and other functions. Disorders may be classified in two ways: disturbances in the production of hormones, and the inability of tissues to respond to hormones. The etiology of these hormone imbalance or endocrine system diseases, disorders or conditions may be genetic, somatic, such as cancer and some autoimmune diseases, acquired (e.g., by chemotherapy, injury or toxins), or infectious. Moreover, polynucleotides, polypeptides, antibodies, and/or agonists or antagonists of the present invention can be used as a marker or detector of a particular disease or disorder related to the endocrine system and/or hormone imbalance.

Endocrine system and/or hormone imbalance and/or diseases encompass disorders of uterine motility including, but not limited to: complications with pregnancy and labor (e.g., pre-term labor, post-term pregnancy, spontaneous abortion, and slow or stopped labor); and disorders and/or diseases of the menstrual cycle (e.g., dysmenorrhea and endometriosis).

Endocrine system and/or hormone imbalance disorders and/or diseases include disorders and/or diseases of the pancreas, such as, for example, diabetes mellitus, diabetes insipidus, congenital pancreatic agenesis, pheochromocytoma—islet cell tumor syndrome; disorders and/or diseases of the adrenal glands such as, for example, Addison's Disease, corticosteroid deficiency, virilizing disease, hirsutism, Cushing's Syndrome, hyperaldosteronism, pheochromocytoma; disorders and/or diseases of the pituitary gland, such as, for example, hyperpituitarism, hypopituitarism, pituitary dwarfism, pituitary adenoma, panhypopituitarism, acromegaly, gigantism; disorders and/or diseases of the thyroid, including but not limited to, hyperthyroidism, hypothyroidism, Plummer's disease, Graves' disease (toxic diffuse goiter), toxic nodular goiter, thyroiditis (Hashimoto's thyroiditis, subacute granulomatous thyroiditis, and silent lymphocytic thyroiditis), Pendred's syndrome, myxedema, cretinism, thyrotoxicosis, thyroid hormone coupling defect, thymic aplasia, Hurthle cell tumours of the thyroid, thyroid cancer, thyroid carcinoma, Medullary thyroid carcinoma; disorders and/or diseases of the parathyroid, such as, for example, hyperparathyroidism, hypoparathyroidism; disorders and/or diseases of the hypothalamus.

In addition, endocrine system and/or hormone imbalance disorders and/or diseases may also include disorders and/or diseases of the testes or ovaries, including cancer. Other disorders and/or diseases of the testes or ovaries further include, for example, ovarian cancer, polycystic ovary syndrome, Klinefelter's syndrome, vanishing testes syndrome (bilateral anorchia), congenital absence of Leydig's cells, cryptorchidism, Noonan's syndrome, myotonic dystrophy, capillary haemangioma of the testis (benign), neoplasias of the testis and neo-testis.

Moreover, endocrine system and/or hormone imbalance disorders and/or diseases may also include disorders and/or diseases such as, for example, polyglandular deficiency syndromes, pheochromocytoma, neuroblastoma, multiple Endocrine neoplasia, and disorders and/or cancers of endocrine tissues.

In another embodiment, a polypeptide of the invention, or polynucleotides, antibodies, agonists, or antagonists corresponding to that polypeptide, may be used to diagnose, prognose, prevent, and/or treat endocrine diseases and/or disorders associated with the tissue(s) in which the polypeptide of the invention is expressed, including one, two, three, four, five, or more tissues disclosed in Table 1B.2, column 5 (Tissue Distribution Library Code).

Reproductive System Disorders

The polynucleotides or polypeptides, or agonists or antagonists of the invention may be used for the diagnosis, treatment, or prevention of diseases and/or disorders of the reproductive system. Reproductive system disorders that can be treated by the compositions of the invention, include, but are not limited to, reproductive system injuries, infections, neoplastic disorders, congenital defects, and diseases or disorders which result in infertility, complications with pregnancy, labor, or parturition, and postpartum difficulties.

Reproductive system disorders and/or diseases include diseases and/or disorders of the testes, including testicular atrophy, testicular feminization, cryptorchism (unilateral and bilateral), anorchia, ectopic testis, epididymitis and orchitis (typically resulting from infections such as, for example, gonorrhea, mumps, tuberculosis, and syphilis), testicular torsion, vasitis nodosa, germ cell tumors (e.g., seminomas, embryonal cell carcinomas, teratocarcinomas, choriocarcinomas, yolk sac tumors, and teratomas), stromal tumors (e.g., Leydig cell tumors), hydrocele, hematocele, varicocele, spermatocele, inguinal hernia, and disorders of sperm production (e.g., immotile cilia syndrome, aspermia, asthenozoospermia, azoospermia, oligospermia, and teratozoospermia).

Reproductive system disorders also include disorders of the prostate gland, such as acute non-bacterial prostatitis, chronic non-bacterial prostatitis, acute bacterial prostatitis, chronic bacterial prostatitis, prostatodystonia, prostatosis, granulomatous prostatitis, malacoplakia, benign prostatic hypertrophy or hyperplasia, and prostate neoplastic disorders, including adenocarcinomas, transitional cell carcinomas, ductal carcinomas, and squamous cell carcinomas.

Additionally, the compositions of the invention may be useful in the diagnosis, treatment, and/or prevention of disorders or diseases of the penis and urethra, including inflammatory disorders, such as balanoposthitis, balanitis xerotica obliterans, phimosis, paraphimosis, syphilis, herpes simplex virus, gonorrhea, non-gonococcal urethritis, chlamydia, mycoplasma, trichomonas, HIV, AIDS, Reiter's syndrome, condyloma acuminatum, condyloma latum, and pearly penile papules; urethral abnormalities, such as hypospadias, epispadias, and phimosis; premalignant lesions, including Erythroplasia of Queyrat, Bowen's disease, Bowenoid paplosis, giant condyloma of Buscke-Lowenstein, and varrucous carcinoma; penile cancers, including squamous cell carcinomas, carcinoma in situ, verrucous carcinoma, and disseminated penile carcinoma; urethral neoplastic disorders, including penile urethral carcinoma, bulbomembranous urethral carcinoma, and prostatic urethral carcinoma; and erectile disorders, such as priapism, Peyronie's disease, erectile dysfunction, and impotence.

Moreover, diseases and/or disorders of the vas deferens include vasculititis and CBAVD (congenital bilateral absence of the vas deferens); additionally, the polynucleotides, polypeptides, and agonists or antagonists of the present invention may be used in the diagnosis, treatment, and/or prevention of diseases and/or disorders of the seminal vesicles, including hydatid disease, congenital chloride diarrhea, and polycystic kidney disease.

Other disorders and/or diseases of the male reproductive system include, for example, Klinefelter's syndrome, Young's syndrome, premature ejaculation, diabetes mellitus, cystic fibrosis, Kartagener's syndrome, high fever, multiple sclerosis, and gynecomastia.

Further, the polynucleotides, polypeptides, and agonists or antagonists of the present invention may be used in the diagnosis, treatment, and/or prevention of diseases and/or disorders of the vagina and vulva, including bacterial vaginosis, candida vaginitis, herpes simplex virus, chancroid, granuloma inguinale, lymphogranuloma venereum, scabies, human papillomavirus, vaginal trauma, vulvar trauma, adenosis, chlamydia vaginitis, gonorrhea, trichomonas vaginitis, condyloma acuminatum, syphilis, molluscum contagiosum, atrophic vaginitis, Paget's disease, lichen sclerosus, lichen planus, vulvodynia, toxic shock syndrome, vaginismus, vulvovaginitis, vulvar vestibulitis, and neoplastic disorders, such as squamous cell hyperplasia, clear cell carcinoma, basal cell carcinoma, melanomas, cancer of Bartholin's gland, and vulvar intraepithelial neoplasia.

Disorders and/or diseases of the uterus include dysmenorrhea, retroverted uterus, endometriosis, fibroids, adenomyosis, anovulatory bleeding, amenorrhea, Cushing's syndrome, hydatidiform moles, Asherman's syndrome, premature menopause, precocious puberty, uterine polyps, dysfunctional uterine bleeding (e.g., due to aberrant hormonal signals), and neoplastic disorders, such as adenocarcinomas, keiomyosarcomas, and sarcomas. Additionally, the polypeptides, polynucleotides, or agonists or antagonists of the invention may be useful as a marker or detector of, as well as in the diagnosis, treatment, and/or prevention of congenital uterine abnormalities, such as bicornuate uterus, septate uterus, simple unicornuate uterus, unicornuate uterus with a noncavitary rudimentary horn, unicornuate uterus with a non-communicating cavitary rudimentary horn, unicornuate uterus with a communicating cavitary horn, arcuate uterus, uterine didelfus, and T-shaped uterus.

Ovarian diseases and/or disorders include anovulation, polycystic ovary syndrome (Stein-Leventhal syndrome), ovarian cysts, ovarian hypofunction, ovarian insensitivity to gonadotropins, ovarian overproduction of androgens, right ovarian vein syndrome, amenorrhea, hirutism, and ovarian cancer (including, but not limited to, primary and secondary cancerous growth, Sertoli-Leydig tumors, endometriod carcinoma of the ovary, ovarian papillary serous adenocarcinoma, ovarian mucinous adenocarcinoma, and Ovarian Krukenberg tumors).

Cervical diseases and/or disorders include cervicitis, chronic cervicitis, mucopurulent cervicitis, cervical dysplasia, cervical polyps, Nabothian cysts, cervical erosion, cervical incompetence, and cervical neoplasms (including, for example, cervical carcinoma, squamous metaplasia, squamous cell carcinoma, adenosquamous cell neoplasia, and columnar cell neoplasia).

Additionally, diseases and/or disorders of the reproductive system include disorders and/or diseases of pregnancy, including miscarriage and stillbirth, such as early abortion, late abortion, spontaneous abortion, induced abortion, therapeutic abortion, threatened abortion, missed abortion, incomplete abortion, complete abortion, habitual abortion, missed abortion, and septic abortion; ectopic pregnancy, anemia, Rh incompatibility, vaginal bleeding during pregnancy, gestational diabetes, intrauterine growth retardation, polyhydramnios, HELLP syndrome, abruptio placentae, placenta previa, hyperemesis, preeclampsia, eclampsia, herpes gestationis, and urticaria of pregnancy. Additionally, the polynucleotides, polypeptides, and agonists or antagonists of the present invention may be used in the diagnosis, treatment, and/or prevention of diseases that can complicate pregnancy, including heart disease, heart failure, rheumatic heart disease, congenital heart disease, mitral valve prolapse, high blood pressure, anemia, kidney disease, infectious disease (e.g., rubella, cytomegalovirus, toxoplasmosis, infectious hepatitis, chlamydia, HIV, AIDS, and genital herpes), diabetes mellitus, Graves' disease, thyroiditis, hypothyroidism, Hashimoto's thyroiditis, chronic active hepatitis, cirrhosis of the liver, primary biliary cirrhosis, asthma, systemic lupus eryematosis, rheumatoid arthritis, myasthenia gravis, idiopathic thrombocytopenic purpura, appendicitis, ovarian cysts, gallbladder disorders, and obstruction of the intestine.

Complications associated with labor and parturition include premature rupture of the membranes, pre-term labor, post-term pregnancy, postmaturity, labor that progresses too slowly, fetal distress (e.g., abnormal heart rate (fetal or maternal), breathing problems, and abnormal fetal position), shoulder dystocia, prolapsed umbilical cord, amniotic fluid embolism, and aberrant uterine bleeding.

Further, diseases and/or disorders of the postdelivery period, including endometritis, myometritis, parametritis, peritonitis, pelvic thrombophlebitis, pulmonary embolism, endotoxemia, pyelonephritis, saphenous thrombophlebitis, mastitis, cystitis, postpartum hemorrhage, and inverted uterus.

Other disorders- and/or diseases of the female reproductive system that may be diagnosed, treated, and/or prevented by the polynucleotides, polypeptides, and agonists or antagonists of the present invention include, for example, Turner's syndrome, pseudohermaphroditism, premenstrual syndrome, pelvic inflammatory disease, pelvic congestion (vascular engorgement), frigidity, anorgasmia, dyspareunia, ruptured fallopian tube, and Mittelschmerz.

Infectious Disease

Polynucleotides or polypeptides, as well as agonists or antagonists of the present invention can be used to treat or detect infectious agents. For example, by increasing the immune response, particularly increasing the proliferation and differentiation of B and/or T cells, infectious diseases may be treated. The immune response may be increased by either enhancing an existing immune response, or by initiating a new immune response. Alternatively, polynucleotides or polypeptides, as well as agonists or antagonists of the present invention may also directly inhibit the infectious agent, without necessarily eliciting an immune response.

Viruses are one example of an infectious agent that can cause disease or symptoms that can be treated or detected by a polynucleotide or polypeptide and/or agonist or antagonist of the present invention. Examples of viruses, include, but are not limited to Examples of viruses, include, but are not limited to the following DNA and RNA viruses and viral families: Arbovirus, Adenoviridae, Arenaviridae, Arterivirus, Birnaviridae, Bunyaviridae, Caliciviridae, Circoviridae, Coronaviridae, Dengue, EBV, HIV, Flaviviridae, Hepadnaviridae (Hepatitis), Herpesviridae (such as, Cytomegalovirus, Herpes Simplex, Herpes Zoster), Mononegavirus (e.g., Paramyxoviridae, Morbillivirus, Rhabdoviridae), Orthomyxoviridae (e.g., Influenza A, Influenza B, and parainfluenza), Papiloma virus, Papovaviridae, Parvoviridae, Picornaviridae, Poxyiridae (such as Smallpox or Vaccinia), Reoviridae (e.g., Rotavirus), Retroviridae (HTLV-I, HTLV-II, Lentivirus), and Togaviridae (e.g., Rubivirus). Viruses falling within these families can cause a variety of diseases or symptoms, including, but not limited to: arthritis, bronchiollitis, respiratory syncytial virus, encephalitis, eye infections (e.g., conjunctivitis, keratitis), chronic fatigue syndrome, hepatitis (A, B, C, E, Chronic Active, Delta), Japanese B encephalitis, Junin, Chikungunya, Rift Valley fever, yellow fever, meningitis, opportunistic infections (e.g., AIDS), pneumonia, Burkitt's Lymphoma, chickenpox, hemorrhagic fever, Measles, Mumps, Parainfluenza, Rabies, the common cold, Polio, leukemia, Rubella, sexually transmitted diseases, skin diseases (e.g., Kaposi's, warts), and viremia. polynucleotides or polypeptides, or agonists or antagonists of the invention, can be used to treat or detect any of these symptoms or diseases. In specific embodiments, polynucleotides, polypeptides, or agonists or antagonists of the invention are used to treat: meningitis, Dengue, EBV, and/or hepatitis (e.g., hepatitis B). In an additional specific embodiment polynucleotides, polypeptides, or agonists or antagonists of the invention are used to treat patients nonresponsive to one or more other commercially available hepatitis vaccines. In a further specific embodiment polynucleotides, polypeptides, or agonists or antagonists of the invention are used to treat AIDS.

Similarly, bacterial and fungal agents that can cause disease or symptoms and that can be treated or detected by a polynucleotide or polypeptide and/or agonist or antagonist of the present invention include, but not limited to, the following Gram-Negative and Gram-positive bacteria, bacterial families, and fungi: *Actinomyces* (e.g., *Norcardia*), *Acinetobacter*, *Cryptococcus neoformans, Aspergillus*, Bacillaceae (e.g., *Bacillus anthrasis*), *Bacteroides* (e.g., *Bacteroides fragilis*), Blastomycosis, *Bordetella, Borrelia* (e.g., *Borrelia burgdorferi*), *Brucella, Candidia, Campylobacter, Chlamydia, Clostridium* (e.g., *Clostridium botulinum, Clostridium dificile, Clostridium perfringens, Clostridium tetani*), *Coccidioides, Corynebacterium* (e.g., *Corynebacterium diptheriae*), *Cryptococcus, Dermatocycoses, E. coli* (e.g., Enterotoxigenic *E. coli* and Enterohemorrhagic *E. coli*), *Enterobacter* (e.g. *Enterobacter aerogenes*), Enterobacteriaceae (*Klebsiella, Salmonella* (e.g., *Salmonella typhi, Salmonella enteritidis, Salmonella typhi*), *Serratia, Yersinia, Shigella*), *Erysipelothrix, Haemophilus* (e.g., *Haemophilus influenza* type B), *Helicobacter, Legionella* (e.g., *Legionella pneumophila*), *Leptospira, Listeria* (e.g., *Listeria monocytogenes*), *Mycoplasma, Mycobacterium* (e.g., *Mycobacterium leprae* and *Mycobacterium tuberculosis*), *Vibrio* (e.g., *Vibrio cholerae*), Neisseriaceae (e.g., *Neisseria gonorrhea, Neisseria meningitidis*), Pasteurellacea, *Proteus, Pseudomonas* (e.g., *Pseudomonas aeruginosa*), Rickettsiaceae, Spirochetes (e.g., *Treponema* spp., *Leptospira* spp., *Borrelia* spp.), *Shigella* spp., *Staphylococcus* (e.g., *Staphylococcus aureus*), *Meningiococcus, Pneumococcus* and *Streptococcus* (e.g., *Streptococcus pneumoniae* and Groups A, B, and C Streptococci), and Ureaplasmas. These bacterial, parasitic, and fungal families can cause diseases or symptoms, including, but not limited to: antibiotic-resistant infections, bacteremia, endocarditis, septicemia, eye infections (e.g., conjunctivitis), uveitis, tuberculosis, gingivitis, bacterial diarrhea, opportunistic infections (e.g., AIDS related infections), paronychia, prosthesis-related infections, dental caries, Reiter's Disease, respiratory tract infections, such as Whooping Cough or Empyema, sepsis, Lyme Disease, Cat-Scratch Disease, dysentery, paratyphoid fever, food poisoning, *Legionella* disease, chronic and acute inflammation, erythema, yeast infections, typhoid, pneumonia, gonorrhea, meningitis (e.g., mengitis types A and B), chlamydia, syphillis, diphtheria, leprosy, brucellosis, peptic ulcers, anthrax, spontaneous abortions, birth defects, pneumonia, lung infections, ear infections, deafness, blindness, lethargy, malaise, vomiting, chronic diarrhea, Crohn's disease, colitis, vaginosis, sterility, pelvic inflammatory diseases, candidiasis, paratuberculosis, tuberculosis, lupus, botulism, gangrene, tetanus, impetigo, Rheumatic Fever, Scarlet Fever, sexually transmitted diseases, skin diseases (e.g., cellulitis, *dermatocycoses*), toxemia, urinary tract infections, wound infections, noscomial infections. Polynucleotides or polypeptides, agonists or antagonists of the invention, can be used to treat or detect any of these symptoms or diseases. In specific embodiments, polynucleotides, polypeptides, agonists or antagonists of the invention are used to treat: tetanus, diptheria, botulism, and/or meningitis type B.

Moreover, parasitic agents causing disease or symptoms that can be treated, prevented, and/or diagnosed by a polynucleotide or polypeptide and/or agonist or antagonist of the present invention include, but not limited to, the following families or class: Amebiasis, Babesiosis, Coccidiosis, Cryptosporidiosis, Dientamoebiasis, Dourine, Ectoparasitic, Giardias, Helminthiasis, Leishmaniasis, Schistisoma, Theileriasis, Toxoplasmosis, Trypanosomiasis, and Trichomonas and Sporozoans (e.g., *Plasmodium virax, Plasmodium falciparium, Plasmodium malariae* and *Plasmodium ovale*). These parasites can cause a variety of diseases or symptoms, including, but not limited to: Scabies, Trombiculiasis, eye infections, intestinal disease (e.g., dysentery, giardiasis), liver disease, lung disease, opportunistic infections (e.g., AIDS related), malaria, pregnancy complications, and toxoplasmosis. polynucleotides or polypeptides, or agonists or antagonists of the invention, can be used to treat, prevent, and/or diagnose any of these symptoms or diseases. In specific embodiments, polynucleotides, polypeptides, or agonists or antagonists of the invention are used to treat, prevent, and/or diagnose malaria.

Polynucleotides or polypeptides, as well as agonists or antagonists of the present invention of the present invention could either be by administering an effective amount of a polypeptide to the patient, or by removing cells from the patient, supplying the cells with a polynucleotide of the present invention, and returning the engineered cells to the patient (ex vivo therapy). Moreover, the polypeptide or polynucleotide of the present invention can be used as an antigen in a vaccine to raise an immune response against infectious disease.

Regeneration

Polynucleotides or polypeptides, as well as agonists or antagonists of the present invention can be used to differentiate, proliferate, and attract cells, leading to the regeneration of tissues. (See, Science 276:59-87 (1997)). The regeneration of tissues could be used to repair, replace, or protect tissue damaged by congenital defects, trauma (wounds, burns, incisions, or ulcers), age, disease (e.g. osteoporosis, osteocarthritis, periodontal disease, liver failure), surgery, including cosmetic plastic surgery, fibrosis, reperfusion injury, or systemic cytokine damage.

Tissues that could be regenerated using the present invention include organs (e.g., pancreas, liver, intestine, kidney, skin, endothelium), muscle (smooth, skeletal or cardiac), vasculature (including vascular and lymphatics), nervous, hematopoietic, and skeletal (bone, cartilage, tendon, and ligament) tissue. Preferably, regeneration occurs without or decreased scarring. Regeneration also may include angiogenesis.

Moreover, polynucleotides or polypeptides, as well as agonists or antagonists of the present invention, may increase regeneration of tissues difficult to heal. For example, increased tendon/ligament regeneration would quicken recovery time after damage. Polynucleotides or polypeptides, as well as agonists or antagonists of the present invention could also be used prophylactically in an effort to avoid damage. Specific diseases that could be treated include of tendinitis, carpal tunnel syndrome, and other tendon or ligament defects. A further example of tissue regeneration of non-healing wounds includes pressure ulcers, ulcers associated with vascular insufficiency, surgical, and traumatic wounds.

Similarly, nerve and brain tissue could also be regenerated by using polynucleotides or polypeptides, as well as agonists or antagonists of the present invention, to proliferate and differentiate nerve cells. Diseases that could be treated using this method include central and peripheral nervous system diseases, neuropathies, or mechanical and traumatic disorders (e.g., spinal cord disorders, head trauma, cerebrovascular disease, and stoke). Specifically, diseases associated with peripheral nerve injuries, peripheral neuropathy (e.g., resulting from chemotherapy or other medical therapies), localized neuropathies, and central nervous system diseases (e.g., Alzheimer's disease, Parkinson's disease, Huntington's disease, amyotrophic lateral sclerosis, and Shy-Drager syndrome), could all be treated using the polynucleotides or polypeptides, as well as agonists or antagonists of the present invention.

Gastrointestinal Disorders

Polynucleotides or polypeptides, or agonists or antagonists of the present invention, may be used to treat, prevent, diagnose, and/or prognose gastrointestinal disorders, including inflammatory diseases and/or conditions, infections, cancers (e.g., intestinal neoplasms (carcinoid tumor of the small intestine, non-Hodgkin's lymphoma of the small intestine, small bowel lymphoma)), and ulcers, such as peptic ulcers.

Gastrointestinal disorders include dysphagia, odynophagia, inflammation of the esophagus, peptic esophagitis, gastric reflux, submucosal fibrosis and stricturing, Mallory-Weiss lesions, leiomyomas, lipomas, epidermal cancers, adeoncarcinomas, gastric retention disorders, gastroenteritis, gastric atrophy, gastric/stomach cancers, polyps of the stomach, autoimmune disorders such as pernicious anemia, pyloric stenosis, gastritis (bacterial, viral, eosinophilic, stress-induced, chronic erosive, atrophic, plasma cell, and Ménétrier's), and peritoneal diseases (e.g., chyloperioneum, hemoperitoneum, mesenteric cyst, mesenteric lymphadenitis, mesenteric vascular occlusion, panniculitis, neoplasms, peritonitis, pneumoperitoneum, bubphrenic abscess).

Gastrointestinal disorders also include disorders associated with the small intestine, such as malabsorption syndromes, distension, irritable bowel syndrome, sugar intolerance, celiac disease, duodenal ulcers, duodenitis, tropical sprue, Whipple's disease, intestinal lymphangiectasia, Crohn's disease, appendicitis, obstructions of the ileum, Meckel's diverticulum, multiple diverticula, failure of complete rotation of the small and large intestine, lymphoma, and bacterial and parasitic diseases (such as Traveler's diarrhea, typhoid and paratyphoid, cholera, infection by Roundworms (*Ascariasis lumbricoides*), Hookworms (*Ancylostoma duodenale*), Threadworms (*Enterobius vermicularis*), Tapeworms (*Taenia saginata, Echinococcus granulosus, Diphyllobothrium* spp., and *T. solium*).

Liver diseases and/or disorders include intrahepatic cholestasis (alagille syndrome, biliary liver cirrhosis), fatty liver (alcoholic fatty liver, reye syndrome), hepatic vein thrombosis, hepatolentricular degeneration, hepatomegaly, hepatopulmonary syndrome, hepatorenal syndrome, portal hypertension (esophageal and gastric varices), liver abscess (amebic liver abscess), liver cirrhosis (alcoholic, biliary and experimental), alcoholic liver diseases (fatty liver, hepatitis, cirrhosis), parasitic (hepatic echinococcosis, fascioliasis, amebic liver abscess), jaundice (hemolytic, hepatocellular, and cholestatic), cholestasis, portal hypertension, liver enlargement, ascites, hepatitis (alcoholic hepatitis, animal hepatitis, chronic hepatitis (autoimmune, hepatitis B, hepatitis C, hepatitis D, drug induced), toxic hepatitis, viral human hepatitis (hepatitis A, hepatitis B, hepatitis C, hepatitis D, hepatitis E), Wilson's disease, granulomatous hepatitis, secondary biliary cirrhosis, hepatic encephalopathy, portal hypertension, varices, hepatic encephalopathy, primary biliary cirrhosis, primary sclerosing cholangitis, hepatocellular adenoma, hemangiomas, bile stones, liver failure (hepatic encephalopathy, acute liver failure), and liver neoplasms (angiomyolipoma, calcified liver metastases, cystic liver metastases, epithelial tumors, fibrolamellar hepatocarcinoma, focal nodular hyperplasia, hepatic adenoma, hepatobiliary cystadenoma, hepatoblastoma, hepatocellular carcinoma, hepatoma, liver cancer, liver hemangioendothelioma, mesenchymal hamartoma, mesenchymal tumors of liver, nodular regenerative hyperplasia, benign liver tumors (Hepatic cysts [Simple cysts, Polycystic liver disease, Hepatobiliary cystadenoma, Choledochal cyst], Mesenchymal tumors [Mesenchymal hamartoma, Infantile hemangioendothelioma, Hemangioma, Peliosis hepatis, Lipomas, Inflammatory pseudotumor, Miscellaneous], Epithelial tumors [Bile duct epithelium (Bile duct hamartoma, Bile duct adenoma), Hepatocyte (Adenoma, Focal nodular hyperplasia, Nodular regenerative hyperplasia)], malignant liver tumors [hepatocellular, hepatoblastoma, hepatocellular carcinoma, cholangiocellular, cholangiocarcinoma, cystadenocarcinoma, tumors of blood vessels, angiosarcoma, Karposi's sarcoma, hemangioendothelioma, other tumors, embryonal sarcoma, fibrosarcoma, leiomyosarcoma, rhabdomyosarcoma, carcinosarcoma, teratoma, carcinoid, squamous carcinoma, primary lymphoma]), peliosis hepatis, erythrohepatic porphyria, hepatic porphyria (acute intermittent porphyria, porphyria cutanea tarda), Zellweger syndrome).

Pancreatic diseases and/or disorders include acute pancreatitis, chronic pancreatitis (acute necrotizing pancreatitis, alcoholic pancreatitis), neoplasms (adenocarcinoma of the pancreas, cystadenocarcinoma, insulinoma, gastrinoma, and glucagonoma, cystic neoplasms, islet-cell tumors, pancreoblastoma), and other pancreatic diseases (e.g., cystic fibrosis, cyst (pancreatic pseudocyst, pancreatic fistula, insufficiency)).

Gallbladder diseases include gallstones (cholelithiasis and choledocholithiasis), postcholecystectomy syndrome, diverticulosis of the gallbladder, acute cholecystitis, chronic cholecystitis, bile duct tumors, and mucocele.

Diseases and/or disorders of the large intestine include antibiotic-associated colitis, diverticulitis, ulcerative colitis, acquired megacolon, abscesses, fungal and bacterial infections, anorectal disorders (e.g., fissures, hemorrhoids), colonic diseases (colitis, colonic neoplasms [colon cancer, adenomatous colon polyps (e.g., villous adenoma), colon carcinoma, colorectal cancer], colonic diverticulitis, colonic diverticulosis, megacolon [Hirschsprung disease, toxic megacolon]; sigmoid diseases [proctocolitis, sigmoin neoplasms]), constipation, Crohn's disease, diarrhea (infantile diarrhea, dysentery), duodenal diseases (duodenal neoplasms, duodenal obstruction, duodenal ulcer, duodenitis), enteritis (enterocolitis), HIV enteropathy, ileal diseases (ileal neoplasms, ileitis), immunoproliferative small intestinal disease, inflammatory bowel disease (ulcerative colitis, Crohn's disease), intestinal atresia, parasitic diseases (anisakiasis, balantidiasis, blastocystis infections, cryptosporidiosis, dientamoebiasis, amebic dysentery, giardiasis), intestinal fistula (rectal fistula), intestinal neoplasms (cecal neoplasms, colonic neoplasms, duodenal neoplasms, ileal neoplasms, intestinal polyps, jejunal neoplasms, rectal neoplasms), intestinal obstruction (afferent loop syndrome, duodenal obstruction, impacted feces, intestinal pseudo-obstruction [cecal volvulus], intussusception), intestinal perforation, intestinal polyps (colonic polyps, gardner syndrome, peutz-jeghers syndrome), jejunal diseases (ejunal neoplasms), malabsorption syndromes (blind loop syndrome, celiac disease, lactose intolerance, short bowl syndrome, tropical sprue, whipple's disease), mesenteric vascular occlusion, pneumatosis cystoides intestinalis, protein-losing enteropathies (intestinal lymphagiectasis), rectal diseases (anus diseases, fecal incontinence, hemorrhoids, proctitis, rectal fistula, rectal prolapse, rectocele), peptic ulcer (duodenal ulcer, peptic esophagitis, hemorrhage, perforation, stomach ulcer, Zollinger-Ellison syndrome), postgastrectomy syndromes (dumping syndrome), stomach diseases (e.g., achlorhydria, duodenogastric reflux (bile reflux), gastric antral vascular ectasia, gastric fistula, gastric outlet obstruction, gastritis (atrophic or hypertrophic), gastroparesis, stomach dilatation, stomach diverticulum, stomach neoplasms (gastric cancer, gastric polyps, gastric adenocarcinoma, hyperplastic gastric polyp), stomach rupture, stomach ulcer, stomach volvulus), tuberculosis, visceroptosis, vomiting (e.g., hematemesis, hyperemesis gravidarum, postoperative nausea and vomiting) and hemorrhagic colitis.

Further diseases and/or disorders of the gastrointestinal system include biliary tract diseases, such as, gastroschisis, fistula (e.g., biliary fistula, esophageal fistula, gastric fistula, intestinal fistula, pancreatic fistula), neoplasms (e.g., biliary tract neoplasms, esophageal neoplasms, such as adenocarcinoma of the esophagus, esophageal squamous cell carcinoma, gastrointestinal neoplasms, pancreatic neoplasms, such as adenocarcinoma of the pancreas, mucinous cystic neoplasm of the pancreas, pancreatic cystic neoplasms, pancreatoblastoma, and peritoneal neoplasms), esophageal disease (e.g., bullous diseases, candidiasis, glycogenic acanthosis, ulceration, barrett esophagus varices, atresia, cyst, diverticulum (e.g., Zenker's diverticulum), fistula (e.g., tracheoesophageal fistula), motility disorders (e.g., CREST syndrome, deglutition disorders, achalasia, spasm, gastroesophageal reflux), neoplasms, perforation (e.g., Boerhaave syndrome, Mallory-Weiss syndrome), stenosis, esophagitis, diaphragmatic hernia (e.g., hiatal hernia); gastrointestinal diseases, such as, gastroenteritis (e.g., cholera morbus, norwalk virus infection), hemorrhage (e.g., hematemesis, melena, peptic ulcer hemorrhage), stomach neoplasms (gastric cancer, gastric polyps, gastric adenocarcinoma, stomach cancer)), hernia (e.g., congenital diaphragmatic hernia, femoral hernia, inguinal hernia, obturator hernia, umbilical hernia, ventral hernia), and intestinal diseases (e.g., cecal diseases (appendicitis, cecal neoplasms)).

Chemotaxis

Polynucleotides or polypeptides, as well as agonists or antagonists of the present invention may have chemotaxis activity. A chemotaxic molecule attracts or mobilizes cells (e.g., monocytes, fibroblasts, neutrophils, T-cells, mast cells, eosinophils, epithelial and/or endothelial cells) to a particular site in the body, such as inflammation, infection, or site of hyperproliferation. The mobilized cells can then fight off and/or heal the particular trauma or abnormality.

Polynucleotides or polypeptides, as well as agonists or antagonists of the present invention may increase chemotaxic activity of particular cells. These chemotactic molecules can then be used to treat inflammation, infection, hyperproliferative disorders, or any immune system disorder by increasing the number of cells targeted to a particular location in the body. For example, chemotaxic molecules can be used to treat wounds and other trauma to tissues by attracting immune cells to the injured location. Chemotactic molecules of the present invention can also attract fibroblasts, which can be used to treat wounds.

It is also contemplated that polynucleotides or polypeptides, as well as agonists or antagonists of the present invention may inhibit chemotactic activity. These molecules could also be used to treat disorders. Thus, polynucleotides or polypeptides, as well as agonists or antagonists of the present invention could be used as an inhibitor of chemotaxis.

Binding Activity

A polypeptide of the present invention may be used to screen for molecules that bind to the polypeptide or for molecules to which the polypeptide binds. The binding of the polypeptide and the molecule may activate (agonist), increase, inhibit (antagonist), or decrease activity of the polypeptide or the molecule bound. Examples of such molecules include antibodies, oligonucleotides, proteins (e.g., receptors), or small molecules.

Preferably, the molecule is closely related to the natural ligand of the polypeptide, e.g., a fragment of the ligand, or a natural substrate, a ligand, a structural or functional mimetic. (See, Coligan et al., Current Protocols in Immunology 1(2): Chapter 5 (1991)). Similarly, the molecule can be closely related to the natural receptor to which the polypeptide binds, or at least, a fragment of the receptor capable of being bound by the polypeptide (e.g., active site). In either case, the molecule can be rationally designed using known techniques.

Preferably, the screening for these molecules involves producing appropriate cells which express the polypeptide. Preferred cells include cells from mammals, yeast, *Drosophila*, or *E. coli*. Cells expressing the polypeptide (or cell membrane containing the expressed polypeptide) are then preferably contacted with a test compound potentially containing the molecule to observe binding, stimulation, or inhibition of activity of either the polypeptide or the molecule.

The assay may simply test binding of a candidate compound to the polypeptide, wherein binding is detected by a label, or in an assay involving competition with a labeled competitor. Further, the assay may test whether the candidate compound results in a signal generated by binding to the polypeptide.

Alternatively, the assay can be carried out using cell-free preparations, polypeptide/molecule affixed to a solid support, chemical libraries, or natural product mixtures. The assay may also simply comprise the steps of mixing a candidate compound with a solution containing a polypeptide, measuring polypeptide/molecule activity or binding, and comparing the polypeptide/molecule activity or binding to a standard.

Preferably, an ELISA assay can measure polypeptide level or activity in a sample (e.g., biological sample) using a monoclonal or polyclonal antibody. The antibody can measure polypeptide level or activity by either binding, directly or indirectly, to the polypeptide or by competing with the polypeptide for a substrate.

Additionally, the receptor to which the polypeptide of the present invention binds can be identified by numerous methods known to those of skill in the art, for example, ligand panning and FACS sorting (Coligan, et al., Current Protocols in Immun., 1(2), Chapter 5, (1991)). For example, expression cloning is employed wherein polyadenylated RNA is prepared from a cell responsive to the polypeptides, for example, NIH3T3 cells which are known to contain multiple receptors for the FGF family proteins, and SC-3 cells, and a cDNA library created from this RNA is divided into pools and used to transfect COS cells or other cells that are not responsive to the polypeptides. Transfected cells which are grown on glass slides are exposed to the polypeptide of the present invention, after they have been labeled. The polypeptides can be labeled by a variety of means including iodination or inclusion of a recognition site for a site-specific protein kinase.

Following fixation and incubation, the slides are subjected to auto-radiographic analysis. Positive pools are identified and sub-pools are prepared and re-transfected using an iterative sub-pooling and re-screening process, eventually yielding a single clones that encodes the putative receptor.

As an alternative approach for receptor identification, the labeled polypeptides can be photoaffinity linked with cell membrane or extract preparations that express the receptor molecule. Cross-linked material is resolved by PAGE analysis and exposed to X-ray film. The labeled complex containing the receptors of the polypeptides can be excised, resolved into peptide fragments, and subjected to protein microsequencing. The amino acid sequence obtained from microsequencing would be used to design a set of degenerate oligonucleotide probes to screen a cDNA library to identify the genes encoding the putative receptors.

Moreover, the techniques of gene-shuffling, motif-shuffling, exon-shuffling, and/or codon-shuffling (collectively referred to as "DNA shuffling") may be employed to modulate the activities of the polypeptide of the present invention thereby effectively generating agonists and antagonists of the polypeptide of the present invention. See generally, U.S. Pat. Nos. 5,605,793, 5,811,238, 5,830,721, 5,834,252, and 5,837,458, and Patten, P. A., et al., Curr. Opinion Biotechnol. 8:724-33 (1997); Harayama, S. Trends Biotechnol. 16(2):76-82 (1998); Hansson, L. O., et al., J. Mol. Biol. 287:265-76 (1999); and Lorenzo, M. M. and Blasco, R. Biotechniques 24(2):308-13 (1998); each of these patents and publications are hereby incorporated by reference). In one embodiment, alteration of polynucleotides and corresponding polypeptides may be achieved by DNA shuffling. DNA shuffling involves the assembly of two or more DNA segments into a desired molecule by homologous, or site-specific, recombination. In another embodiment, polynucleotides and corresponding polypeptides may be altered by being subjected to random mutagenesis by error-prone PCR, random nucleotide insertion or other methods prior to recombination. In another embodiment, one or more components, motifs, sections, parts, domains, fragments, etc., of the polypeptide of the present invention may be recombined with one or more components, motifs, sections, parts, domains, fragments, etc. of one or more heterologous molecules. In preferred embodiments, the heterologous molecules are family members. In further preferred embodiments, the heterologous molecule is a growth factor such as, for example, platelet-derived growth factor (PDGF), insulin-like growth factor (IGF-I), transforming growth factor (TGF)-alpha, epidermal growth factor (EGF), fibroblast growth factor (FGF), TGF-beta, bone morphogenetic protein (BMP)-2, BMP-4, BMP-5, BMP-6, BMP-7, activins A and B, decapentaplegic(dpp), 60A, OP-2, dorsalin, growth differentiation factors (GDFs), nodal, MIS, inhibin-alpha, TGF-beta1, TGF-beta2, TGF-beta3, TGF-beta5, and glial-derived neurotrophic factor (GDNF).

Other preferred fragments are biologically active fragments of the polypeptide of the present invention. Biologically active fragments are those exhibiting activity similar, but not necessarily identical, to an activity of the polypeptide of the present invention. The biological activity of the fragments may include an improved desired activity, or a decreased undesirable activity.

Additionally, this invention provides a method of screening compounds to identify those which modulate the action of the polypeptide of the present invention. An example of such an assay comprises combining a mammalian fibroblast cell, a the polypeptide of the present invention, the compound to be screened and $^3$[H] thymidine under cell culture conditions where the fibroblast cell would normally proliferate. A control assay may be performed in the absence of the compound to be screened and compared to the amount of fibroblast proliferation in the presence of the compound to determine if the compound stimulates proliferation by determining the uptake of $^3$[H] thymidine in each case. The amount of fibroblast cell proliferation is measured by liquid scintillation chromatography which measures the incorporation of $^3$ [H] thymidine. Both agonist and antagonist compounds may be identified by this procedure.

In another method, a mammalian cell or membrane preparation expressing a receptor for a polypeptide of the present invention is incubated with a labeled polypeptide of the present invention in the presence of the compound. The ability of the compound to enhance or block this interaction could then be measured. Alternatively, the response of a known second messenger system following interaction of a compound to be screened and the receptor is measured and the ability of the compound to bind to the receptor and elicit a second messenger response is measured to determine if the compound is a potential agonist or antagonist. Such second messenger systems include but are not limited to, cAMP guanylate cyclase, ion channels or phosphoinositide hydrolysis.

All of these above assays can be used as diagnostic or prognostic markers. The molecules discovered using these assays can be used to treat disease or to bring about a particular result in a patient (e.g., blood vessel growth) by activating or inhibiting the polypeptide/molecule. Moreover, the assays can discover agents which may inhibit or enhance the production of the polypeptides of the invention from suitably manipulated cells or tissues.

Therefore, the invention includes a method of identifying compounds which bind to a polypeptide of the invention comprising the steps of: (a) incubating a candidate binding compound with a polypeptide of the present invention; and (b) determining if binding has occurred. Moreover, the invention includes a method of identifying agonists/antagonists comprising the steps of: (a) incubating a candidate compound with a polypeptide of the present invention, (b) assaying a biological activity, and (b) determining if a biological activity of the polypeptide has been altered.

Targeted Delivery

In another embodiment, the invention provides a method of delivering compositions to targeted cells expressing a receptor for a polypeptide of the invention, or cells expressing a cell bound form of a polypeptide of the invention.

As discussed herein, polypeptides or antibodies of the invention may be associated with heterologous polypeptides, heterologous nucleic acids, toxins, or prodrugs via hydrophobic, hydrophilic, ionic and/or covalent interactions. In one embodiment, the invention provides a method for the specific delivery of compositions of the invention to cells by administering polypeptides of the invention (including antibodies) that are associated with heterologous polypeptides or nucleic acids. In one example, the invention provides a method for delivering a therapeutic protein into the targeted cell. In another example, the invention provides a method for delivering a single stranded nucleic acid (e.g., antisense or ribozymes) or double stranded nucleic acid (e.g., DNA that can integrate into the cell's genome or replicate episomally and that can be transcribed) into the targeted cell.

In another embodiment, the invention provides a method for the specific destruction of cells (e.g., the destruction of tumor cells) by administering polypeptides of the invention (e.g., polypeptides of the invention or antibodies of the invention) in association with toxins or cytotoxic prodrugs.

By "toxin" is meant compounds that bind and activate endogenous cytotoxic effector systems, radioisotopes, holotoxins, modified toxins, catalytic subunits of toxins, or any molecules or enzymes not normally present in or on the surface of a cell that under defined conditions cause the cell's death. Toxins that may be used according to the methods of the invention include, but are not limited to, radioisotopes known in the art, compounds such as, for example, antibodies (or complement fixing containing portions thereof) that bind an inherent or induced endogenous cytotoxic effector system, thymidine kinase, endonuclease, RNAse, alpha toxin, ricin, abrin, *Pseudomonas* exotoxin A, diphtheria toxin, saporin, momordin, gelonin, pokeweed antiviral protein, alpha-sarcin and cholera toxin. By "cytotoxic prodrug" is meant a nontoxic compound that is converted by an enzyme, normally present in the cell, into a cytotoxic compound. Cytotoxic prodrugs that may be used according to the methods of the invention include, but are not limited to, glutamyl derivatives of benzoic acid mustard alkylating agent, phosphate derivatives of etoposide or mitomycin C, cytosine arabinoside, daunorubisin, and phenoxyacetamide derivatives of doxorubicin.

Drug Screening

Further contemplated is the use of the polypeptides of the present invention, or the polynucleotides encoding these polypeptides, to screen for molecules which modify the activities of the polypeptides of the present invention. Such a method would include contacting the polypeptide of the present invention with a selected compound(s) suspected of having antagonist or agonist activity, and assaying the activity of these polypeptides following binding.

This invention is particularly useful for screening therapeutic compounds by using the polypeptides of the present invention, or binding fragments thereof, in any of a variety of drug screening techniques. The polypeptide or fragment employed in such a test may be affixed to a solid support, expressed on a cell surface, free in solution, or located intracellularly. One method of drug screening utilizes eukaryotic or prokaryotic host cells which are stably transformed with recombinant nucleic acids expressing the polypeptide or fragment. Drugs are screened against such transformed cells in competitive binding assays. One may measure, for example, the formulation of complexes between the agent being tested and a polypeptide of the present invention.

Thus, the present invention provides methods of screening for drugs or any other agents which affect activities mediated by the polypeptides of the present invention. These methods comprise contacting such an agent with a polypeptide of the present invention or a fragment thereof and assaying for the presence of a complex between the agent and the polypeptide or a fragment thereof, by methods well known in the art. In such a competitive binding assay, the agents to screen are typically labeled. Following incubation, free agent is separated from that present in bound form, and the amount of free or uncomplexed label is a measure of the ability of a particular agent to bind to the polypeptides of the present invention.

Another technique for drug screening provides high throughput screening for compounds having suitable binding affinity to the polypeptides of the present invention, and is described in great detail in European Patent Application 84/03564, published on Sep. 13, 1984, which is incorporated herein by reference herein. Briefly stated, large numbers of different small peptide test compounds are synthesized on a solid substrate, such as plastic pins or some other surface. The peptide test compounds are reacted with polypeptides of the present invention and washed. Bound polypeptides are then detected by methods well known in the art. Purified polypeptides are coated directly onto plates for use in the aforementioned drug screening techniques. In addition, non-neutralizing antibodies may be used to capture the peptide and immobilize it on the solid support.

This invention also contemplates the use of competitive drug screening assays in which neutralizing antibodies capable of binding polypeptides of the present invention specifically compete with a test compound for binding to the polypeptides or fragments thereof. In this manner, the antibodies are used to detect the presence of any peptide which shares one or more antigenic epitopes with a polypeptide of the invention.

Antisense And Ribozyme (Antagonists)

In specific embodiments, antagonists according to the present invention are nucleic acids corresponding to the sequences contained in SEQ ID NO:X, or the complementary strand thereof, and/or to cDNA sequences contained in cDNA ATCC™ Deposit No:Z identified for example, in Table 1A and/or 1B. In one embodiment, antisense sequence is generated internally, by the organism, in another embodiment, the antisense sequence is separately administered (see, for example, O'Connor, J., Neurochem. 56:560 (1991). Oligodeoxynucleotides as Antisense Inhibitors of Gene Expression, CRC Press, Boca Raton, Fla. (1988). Antisense technology can be used to control gene expression through antisense DNA or RNA, or through triple-helix formation. Antisense techniques are discussed for example, in Okano, J., Neurochem. 56:560 (1991); Oligodeoxynucleotides as Antisense Inhibitors of Gene Expression, CRC Press, Boca Raton, Fla. (1988). Triple helix formation is discussed in, for instance, Lee et al., Nucleic Acids Research 6:3073 (1979); Cooney et al., Science 241:456 (1988); and Dervan et al., Science 251:1300 (1991). The methods are based on binding of a polynucleotide to a complementary DNA or RNA.

For example, the use of c-myc and c-myb antisense RNA constructs to inhibit the growth of the non-lymphocytic leukemia cell line HL-60 and other cell lines was previously described. (Wickstrom et al. (1988); Anfossi et al. (1989)). These experiments were performed in vitro by incubating cells with the oligoribonucleotide. A similar procedure for in vivo use is described in WO 91/15580. Briefly, a pair of oligonucleotides for a given antisense RNA is produced as follows: A sequence complimentary to the first 15 bases of the open reading frame is flanked by an EcoR1 site on the 5 end and a HindIII site on the 3 end. Next, the pair of oligonucleotides is heated at 90° C. for one minute and then annealed in 2× ligation buffer (20 mM TRIS HCl pH 7.5, 10 mM MgCl2, 10 MM dithiothreitol (DTT) and 0.2 mM ATP) and then ligated to the EcoR1/Hind III site of the retroviral vector PMV7 (WO 91/15580).

For example, the 5' coding portion of a polynucleotide that encodes the polypeptide of the present invention may be used to design an antisense RNA oligonucleotide of from about 10 to 40 base pairs in length. A DNA oligonucleotide is designed to be complementary to a region of the gene involved in transcription thereby preventing transcription and the production of the receptor. The antisense RNA oligonucleotide hybridizes to the mRNA in vivo and blocks translation of the mRNA molecule into receptor polypeptide.

In one embodiment, the antisense nucleic acid of the invention is produced intracellularly by transcription from an exogenous sequence. For example, a vector or a portion thereof, is transcribed, producing an antisense nucleic acid (RNA) of the invention. Such a vector would contain a sequence encoding the antisense nucleic acid. Such a vector can remain episomal or become chromosomally integrated, as long as it can be transcribed to produce the desired antisense RNA. Such vectors can be constructed by recombinant DNA technology methods standard in the art. Vectors can be plasmid, viral, or others known in the art, used for replication and expression in vertebrate cells. Expression of the sequence encoding the polypeptide of the present invention or fragments thereof, can be by any promoter known in the art to act in vertebrate, preferably human cells. Such promoters can be inducible or constitutive. Such promoters include, but are not limited to, the SV40 early promoter region (Bernoist and Chambon, Nature 29:304-310 (1981), the promoter contained in the 3' long terminal repeat of Rous sarcoma virus (Yamamoto et al., Cell 22:787-797 (1980), the herpes thymidine promoter (Wagner et al., Proc. Natl. Acad. Sci. U.S.A. 78:1441-1445 (1981), the regulatory sequences of the metallothionein gene (Brinster, et al., Nature 296:39-42 (1982)), etc.

The antisense nucleic acids of the invention comprise a sequence complementary to at least a portion of an RNA transcript of a gene of the present invention. However, absolute complementarity, although preferred, is not required. A sequence "complementary to at least a portion of an RNA," referred to herein, means a sequence having sufficient complementarity to be able to hybridize with the RNA, forming a stable duplex; in the case of double stranded antisense nucleic acids, a single strand of the duplex DNA may thus be tested, or triplex formation may be assayed. The ability to hybridize will depend on both the degree of complementarity and the length of the antisense nucleic acid. Generally, the larger the hybridizing nucleic acid, the more base mismatches with a RNA it may contain and still form a stable duplex (or triplex as the case may be). One skilled in the art can ascertain a tolerable degree of mismatch by use of standard procedures to determine the melting point of the hybridized complex.

Oligonucleotides that are complementary to the 5' end of the message, e.g., the 5' untranslated sequence up to and including the AUG initiation codon, should work most efficiently at inhibiting translation. However, sequences complementary to the 3' untranslated sequences of mRNAs have been shown to be effective at inhibiting translation of mRNAs as well. See generally, Wagner, R., 1994, Nature 372:333-335. Thus, oligonucleotides complementary to either the 5'- or 3'-non-translated, non-coding regions of polynucleotide sequences described herein could be used in an antisense approach to inhibit translation of endogenous mRNA. Oligonucleotides complementary to the 5' untranslated region of the mRNA should include the complement of the AUG start codon. Antisense oligonucleotides complementary to mRNA coding regions are less efficient inhibitors of translation but could be used in accordance with the invention. Whether designed to hybridize to the 5'-, 3'- or coding region of mRNA of the present invention, antisense nucleic acids should be at least six nucleotides in length, and are preferably oligonucleotides ranging from 6 to about 50 nucleotides in length. In specific aspects the oligonucleotide is at least 10 nucleotides, at least 17 nucleotides, at least 25 nucleotides or at least 50 nucleotides.

The polynucleotides of the invention can be DNA or RNA or chimeric mixtures or derivatives or modified versions thereof, single-stranded or double-stranded. The oligonucleotide can be modified at the base moiety, sugar moiety, or phosphate backbone, for example, to improve stability of the molecule, hybridization, etc. The oligonucleotide may include other appended groups such as peptides (e.g., for targeting host cell receptors in vivo), or agents facilitating transport across the cell membrane (see, e.g., Letsinger et al., 1989, Proc. Natl. Acad. Sci. U.S.A. 86:6553-6556; Lemaitre et al., 1987, Proc. Natl. Acad. Sci. 84:648-652; PCT Publication No. WO88/09810, published Dec. 15, 1988) or the blood-brain barrier (see, e.g., PCT Publication No. WO89/10134, published Apr. 25, 1988), hybridization-triggered cleavage agents. (See, e.g., Krol et al., 1988, BioTechniques 6:958-976) or intercalating agents. (See, e.g., Zon, 1988, Pharm. Res. 5:539-549). To this end, the oligonucleotide may be conjugated to another molecule, e.g., a peptide, hybridization triggered cross-linking agent, transport agent, hybridization-triggered cleavage agent, etc.

The antisense oligonucleotide may comprise at least one modified base moiety which is selected from the group including, but not limited to, 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine.

The antisense oligonucleotide may also comprise at least one modified sugar moiety selected from the group including, but not limited to, arabinose, 2-fluoroarabinose, xylulose, and hexose.

In yet another embodiment, the antisense oligonucleotide comprises at least one modified phosphate backbone selected from the group including, but not limited to, a phosphorothioate, a phosphorodithioate, a phosphoramidothioate, a phosphoramidate, a phosphordiamidate, a methylphosphonate, an alkyl phosphotriester, and a formacetal or analog thereof.

In yet another embodiment, the antisense oligonucleotide is an a-anomeric oligonucleotide. An a-anomeric oligonucleotide forms specific double-stranded hybrids with complementary RNA in which, contrary to the usual b-units, the strands run parallel to each other (Gautier et al., 1987, Nucl. Acids Res. 15:6625-6641). The oligonucleotide is a 2'-O-methylribonucleotide (Inoue et al., 1987, Nucl. Acids Res. 15:6131-6148), or a chimeric RNA-DNA analogue (Inoue et al., 1987, FEBS Lett. 215:327-330).

Polynucleotides of the invention may be synthesized by standard methods known in the art, e.g. by use of an automated DNA synthesizer (such as are commercially available from Biosearch, Applied Biosystems, etc.). As examples, phosphorothioate oligonucleotides may be synthesized by the method of Stein et al. (1988, Nucl. Acids Res. 16:3209), methylphosphonate oligonucleotides can be prepared by use of controlled pore glass polymer supports (Sarin et al., 1988, Proc. Natl. Acad. Sci. U.S.A. 85:7448-7451), etc.

While antisense nucleotides complementary to the coding region sequence could be used, those complementary to the transcribed untranslated region are most preferred.

Potential antagonists according to the invention also include catalytic RNA, or a ribozyme (See, e.g., PCT International Publication WO 90/11364, published Oct. 4, 1990; Sarver et al, Science 247:1222-1225 (1990). While ribozymes that cleave mRNA at site specific recognition sequences can be used to destroy mRNAs, the use of hammerhead ribozymes is preferred. Hammerhead ribozymes cleave mRNAs at locations dictated by flanking regions that form complementary base pairs with the target mRNA. The sole requirement is that the target mRNA have the following sequence of two bases: 5'-UG-3'. The construction and production of hammerhead ribozymes is well known in the art and is described more fully in Haseloff and Gerlach, Nature 334:585-591 (1988). There are numerous potential hammerhead ribozyme cleavage sites within the nucleotide sequence of SEQ ID NO:X. Preferably, the ribozyme is engineered so that the cleavage recognition site is located near the 5' end of the mRNA; i.e., to increase efficiency and minimize the intracellular accumulation of non-functional mRNA transcripts.

As in the antisense approach, the ribozymes of the invention can be composed of modified oligonucleotides (e.g., for improved stability, targeting, etc.) and should be delivered to cells which express in vivo. DNA constructs encoding the ribozyme may be introduced into the cell in the same manner as described above for the introduction of antisense encoding DNA. A preferred method of delivery involves using a DNA construct "encoding" the ribozyme under the control of a strong constitutive promoter, such as, for example, pol III or pol II promoter, so that transfected cells will produce sufficient quantities of the ribozyme to destroy endogenous messages and inhibit translation. Since ribozymes unlike antisense molecules, are catalytic, a lower intracellular concentration is required for efficiency.

Antagonist/agonist compounds may be employed to inhibit the cell growth and proliferation effects of the polypeptides of the present invention on neoplastic cells and tissues, i.e. stimulation of angiogenesis of tumors, and, therefore, retard or prevent abnormal cellular growth and proliferation, for example, in tumor formation or growth.

The antagonist/agonist may also be employed to prevent hyper-vascular diseases, and prevent the proliferation of epithelial lens cells after extracapsular cataract surgery. Prevention of the mitogenic activity of the polypeptides of the present invention may also be desirous in cases such as restenosis after balloon angioplasty.

The antagonist/agonist may also be employed to prevent the growth of scar tissue during wound healing.

The antagonist/agonist may also be employed to treat the diseases described herein.

Thus, the invention provides a method of treating disorders or diseases, including but not limited to the disorders or diseases listed throughout this application, associated with overexpression of a polynucleotide of the present invention by administering to a patient (a) an antisense molecule directed to the polynucleotide of the present invention, and/or (b) a ribozyme directed to the polynucleotide of the present invention.

Binding Peptides and Other Molecules

The invention also encompasses screening methods for identifying polypeptides and nonpolypeptides that bind polypeptides of the invention, and the binding molecules identified thereby. These binding molecules are useful, for example, as agonists and antagonists of the polypeptides of the invention. Such agonists and antagonists can be used, in accordance with the invention, in the therapeutic embodiments described in detail, below.

This method comprises the steps of:
  a. contacting polypeptides of the invention with a plurality of molecules; and
  b. identifying a molecule that binds the polypeptides of the invention.

The step of contacting the polypeptides of the invention with the plurality of molecules may be effected in a number of ways. For example, one may contemplate immobilizing the polypeptides on a solid support and bringing a solution of the plurality of molecules in contact with the immobilized polypeptides. Such a procedure would be akin to an affinity chromatographic process, with the affinity matrix being comprised of the immobilized polypeptides of the invention. The molecules having a selective affinity for the polypeptides can then be purified by affinity selection. The nature of the solid support, process for attachment of the polypeptides to the solid support, solvent, and conditions of the affinity isolation or selection are largely conventional and well known to those of ordinary skill in the art.

Alternatively, one may also separate a plurality of polypeptides into substantially separate fractions comprising a subset of or individual polypeptides. For instance, one can separate the plurality of polypeptides by gel electrophoresis, column chromatography, or like method known to those of ordinary skill for the separation of polypeptides. The individual polypeptides can also be produced by a transformed host cell in such a way as to be expressed on or about its outer surface (e.g., a recombinant phage). Individual isolates can then be "probed" by the polypeptides of the invention, optionally in the presence of an inducer should one be required for expression, to determine if any selective affinity interaction takes place between the polypeptides and the individual clone. Prior to contacting the polypeptides with each fraction comprising individual polypeptides, the polypeptides could first be transferred to a solid support for additional convenience. Such a solid support may simply be a piece of filter membrane, such as one made of nitrocellulose or nylon. In this manner, positive clones could be identified from a collection of transformed host cells of an expression library, which harbor a DNA construct encoding a polypeptide having a selective affinity for polypeptides of the invention. Furthermore, the amino acid sequence of the polypeptide having a selective affinity for the polypeptides of the invention can be determined directly by conventional means or the coding sequence of the DNA encoding the polypeptide can frequently be determined more conveniently. The primary sequence can then be deduced from the corresponding DNA sequence. If the amino acid sequence is to be determined from the polypeptide itself, one may use microsequencing techniques. The sequencing technique may include mass spectroscopy.

In certain situations, it may be desirable to wash away any unbound polypeptides from a mixture of the polypeptides of the invention and the plurality of polypeptides prior to attempting to determine or to detect the presence of a selective affinity interaction. Such a wash step may be particularly desirable when the polypeptides of the invention or the plurality of polypeptides are bound to a solid support.

The plurality of molecules provided according to this method may be provided by way of diversity libraries, such as random or combinatorial peptide or nonpeptide libraries which can be screened for molecules that specifically bind polypeptides of the invention. Many libraries are known in the art that can be used, e.g., chemically synthesized libraries, recombinant (e.g., phage display libraries), and in vitro translation-based libraries. Examples of chemically synthesized libraries are described in Fodor et al., 1991, Science 251:767-773; Houghten et al., 1991, Nature 354:84-86; Lam et al., 1991, Nature 354:82-84; Medynski, 1994, Bio/Technology 12:709-710; Gallop et al., 1994, J. Medicinal Chemistry 37(9):1233-1251; Ohlmeyer et al., 1993, Proc. Natl. Acad. Sci. USA 90:10922-10926; Erb et al., 1994, Proc. Natl. Acad. Sci. USA 91:11422-11426; Houghten et al., 1992, Biotechniques 13:412; Jayawickreme et al., 1994, Proc. Natl. Acad. Sci. USA 91:1614-1618; Salmon et al., 1993, Proc. Natl. Acad. Sci. USA 90:11708-11712; PCT Publication No. WO 93/20242; and Brenner and Lerner, 1992, Proc. Natl. Acad. Sci. USA 89:5381-5383.

Examples of phage display libraries are described in Scott and Smith, 1990, Science 249:386-390; Devlin et al., 1990, Science, 249:404-406; Christian, R. B., et al., 1992, J. Mol. Biol. 227:711-718); Lenstra, 1992, J. Immunol. Meth. 152:149-157; Kay et al., 1993, Gene 128:59-65; and PCT Publication No. WO 94/18318 dated Aug. 18, 1994.

In vitro translation-based libraries include but are not limited to those described in PCT Publication No. WO 91/05058 dated Apr. 18, 1991; and Mattheakis et al., 1994, Proc. Natl. Acad. Sci. USA 91:9022-9026.

By way of examples of nonpeptide libraries, a benzodiazepine library (see e.g., Bunin et al., 1994, Proc. Natl. Acad. Sci. USA 91:4708-4712) can be adapted for use. Peptoid libraries (Simon et al., 1992, Proc. Natl. Acad. Sci. USA 89:9367-9371) can also be used. Another example of a library that can be used, in which the amide functionalities in peptides have been permethylated to generate a chemically transformed combinatorial library, is described by Ostresh et al. (1994, Proc. Natl. Acad. Sci. USA 91:11138-11142).

The variety of non-peptide libraries that are useful in the present invention is great. For example, Ecker and Crooke, 1995, Bio/Technology 13:351-360 list benzodiazepines, hydantoins, piperazinediones, biphenyls, sugar analogs, beta-mercaptoketones, arylacetic acids, acylpiperidines, benzopyrans, cubanes, xanthines, aminimides, and oxazolones as among the chemical species that form the basis of various libraries.

Non-peptide libraries can be classified broadly into two types: decorated monomers and oligomers. Decorated monomer libraries employ a relatively simple scaffold structure upon which a variety functional groups is added. Often the scaffold will be a molecule with a known useful pharmacological activity. For example, the scaffold might be the benzodiazepine structure.

Non-peptide oligomer libraries utilize a large number of monomers that are assembled together in ways that create new shapes that depend on the order of the monomers. Among the monomer units that have been used are carbamates, pyrrolinones, and morpholinos. Peptoids, peptide-like oligomers in which the side chain is attached to the alpha amino group rather than the alpha carbon, form the basis of another version of non-peptide oligomer libraries. The first non-peptide oligomer libraries utilized a single type of monomer and thus contained a repeating backbone. Recent libraries have utilized more than one monomer, giving the libraries added flexibility.

Screening the libraries can be accomplished by any of a variety of commonly known methods. See, e.g., the following references, which disclose screening of peptide libraries: Parmley and Smith, 1989, Adv. Exp. Med. Biol. 251:215-218; Scott and Smith, 1990, Science 249:386-390; Fowlkes et al., 1992; BioTechniques 13:422-427; Oldenburg et al., 1992, Proc. Natl. Acad. Sci. USA 89:5393-5397; Yu et al., 1994, Cell 76:933-945; Staudt et al., 1988, Science 241:577-580; Bock et al., 1992, Nature 355:564-566; Tuerk et al., 1992, Proc. Natl. Acad. Sci. USA 89:6988-6992; Ellington et al., 1992, Nature 355:850-852; U.S. Pat. No. 5,096,815, U.S. Pat. No. 5,223,409, and U.S. Pat. No. 5,198,346, all to Ladner et al.; Rebar and Pabo, 1993, Science 263:671-673; and CT Publication No. WO 94/18318.

In a specific embodiment, screening to identify a molecule that binds polypeptides of the invention can be carried out by contacting the library members with polypeptides of the invention immobilized on a solid phase and harvesting those library members that bind to the polypeptides of the invention. Examples of such screening methods, termed "panning" techniques are described by way of example in Parmley and Smith, 1988, Gene 73:305-318; Fowlkes et al., 1992, Bio-Techniques 13:422-427; PCT Publication No. WO 94/18318; and in references cited herein.

In another embodiment, the two-hybrid system for selecting interacting proteins in yeast (Fields and Song, 1989, Nature 340:245-246; Chien et al., 1991, Proc. Natl. Acad. Sci. USA 88:9578-9582) can be used to identify molecules that specifically bind to polypeptides of the invention.

Where the binding molecule is a polypeptide, the polypeptide can be conveniently selected from any peptide library, including random peptide libraries, combinatorial peptide libraries, or biased peptide libraries. The term "biased" is used herein to mean that the method of generating the library is manipulated so as to restrict one or more parameters that govern the diversity of the resulting collection of molecules, in this case peptides.

Thus, a truly random peptide library would generate a collection of peptides in which the probability of finding a particular amino acid at a given position of the peptide is the same for all 20 amino acids. A bias can be introduced into the library, however, by specifying, for example, that a lysine occur every fifth amino acid or that positions 4, 8, and 9 of a decapeptide library be fixed to include only arginine. Clearly, many types of biases can be contemplated, and the present invention is not restricted to any particular bias. Furthermore, the present invention contemplates specific types of peptide libraries, such as phage displayed peptide libraries and those that utilize a DNA construct comprising a lambda phage vector with a DNA insert.

As mentioned above, in the case of a binding molecule that is a polypeptide, the polypeptide may have about 6 to less than about 60 amino acid residues, preferably about 6 to about 10 amino acid residues, and most preferably, about 6 to about 22 amino acids. In another embodiment, a binding polypeptide has in the range of 15-100 amino acids, or 20-50 amino acids.

The selected binding polypeptide can be obtained by chemical synthesis or recombinant expression.

Other Activities

A polypeptide, polynucleotide, agonist, or antagonist of the present invention, as a result of the ability to stimulate vascular endothelial cell growth, may be employed in treatment for stimulating re-vascularization of ischemic tissues due to various disease conditions such as thrombosis, arteriosclerosis, and other cardiovascular conditions. The polypeptide, polynucleotide, agonist, or antagonist of the present invention may also be employed to stimulate angiogenesis and limb regeneration, as discussed above.

A polypeptide, polynucleotide, agonist, or antagonist of the present invention may also be employed for treating wounds due to injuries, burns, post-operative tissue repair, and ulcers since they are mitogenic to various cells of different origins, such as fibroblast cells and skeletal muscle cells, and therefore, facilitate the repair or replacement of damaged or diseased tissue.

A polypeptide, polynucleotide, agonist, or antagonist of the present invention may also be employed stimulate neuronal growth and to treat and prevent neuronal damage which occurs in certain neuronal disorders or neuro-degenerative conditions such as Alzheimer's disease, Parkinson's disease, and AIDS-related complex. A polypeptide, polynucleotide, agonist, or antagonist of the present invention may have the ability to stimulate chondrocyte growth, therefore, they may be employed to enhance bone and periodontal regeneration and aid in tissue transplants or bone grafts.

A polypeptide, polynucleotide, agonist, or antagonist of the present invention may be also be employed to prevent skin aging due to sunburn by stimulating keratinocyte growth.

A polypeptide, polynucleotide, agonist, or antagonist of the present invention may also be employed for preventing hair loss, since FGF family members activate hair-forming cells and promotes melanocyte growth. Along the same lines, a polypeptide, polynucleotide, agonist, or antagonist of the present invention may be employed to stimulate growth and differentiation of hematopoietic cells and bone marrow cells when used in combination with other cytokines.

A polypeptide, polynucleotide, agonist, or antagonist of the present invention may also be employed to maintain organs before transplantation or for supporting cell culture of primary tissues. A polypeptide, polynucleotide, agonist, or antagonist of the present invention may also be employed for inducing tissue of mesodermal origin to differentiate in early embryos.

A polypeptide, polynucleotide, agonist, or antagonist of the present invention may also increase or decrease the differentiation or proliferation of embryonic stem cells, besides, as discussed above, hematopoietic lineage.

A polypeptide, polynucleotide, agonist, or antagonist of the present invention may also be used to modulate mammalian characteristics, such as body height, weight, hair color, eye color, skin, percentage of adipose tissue, pigmentation, size, and shape (e.g., cosmetic surgery). Similarly, a polypeptide, polynucleotide, agonist, or antagonist of the present invention may be used to modulate mammalian metabolism affecting catabolism, anabolism, processing, utilization, and storage of energy.

A polypeptide, polynucleotide, agonist, or antagonist of the present invention may be used to change a mammal's mental state or physical state by influencing biorhythms, caricadic rhythms, depression (including depressive disorders), tendency for violence, tolerance for pain, reproductive capabilities (preferably by Activin or Inhibin-like activity), hormonal or endocrine levels, appetite, libido, memory, stress, or other cognitive qualities.

A polypeptide, polynucleotide, agonist, or antagonist of the present invention may also be used as a food additive or preservative, such as to increase or decrease storage capabilities, fat content, lipid, protein, carbohydrate, vitamins, minerals, cofactors or other nutritional components.

The above-recited applications have uses in a wide variety of hosts. Such hosts include, but are not limited to, human, murine, rabbit, goat, guinea pig, camel, horse, mouse, rat, hamster, pig, micro-pig, chicken, goat, cow, sheep, dog, cat, non-human primate, and human. In specific embodiments, the host is a mouse, rabbit, goat, guinea pig, chicken, rat, hamster, pig, sheep, dog or cat. In preferred embodiments, the host is a mammal. In most preferred embodiments, the host is a human.

Other Preferred Embodiments

Other preferred embodiments of the claimed invention include an isolated nucleic acid molecule comprising a nucleotide sequence which is at least 95% identical to a sequence of at least about 50 contiguous nucleotides in the nucleotide sequence of SEQ ID NO:X or the complementary strand thereto, the nucleotide sequence as defined in column 5 of Table 1B.1 or columns 8 and 9 of Table 2 or the complementary strand thereto, and/or cDNA contained in ATCC™ Deposit No:Z.

Also preferred is a nucleic acid molecule wherein said sequence of contiguous nucleotides is included in the nucleotide sequence of the portion of SEQ ID NO:X as defined in column 5, "ORF (From-To)", in Table 1B.1.

Also preferred is a nucleic acid molecule wherein said sequence of contiguous nucleotides is included in the nucleotide sequence of the portion of SEQ ID NO:X as defined in columns 8 and 9, "NT From" and "NT To" respectively, in Table 2.

Also preferred is an isolated nucleic acid molecule comprising a nucleotide sequence which is at least 95% identical to a sequence of at least about 150 contiguous nucleotides in the nucleotide sequence of SEQ ID NO:X or the complementary strand thereto, the nucleotide sequence as defined in column 5 of Table 1B.1 or columns 8 and 9 of Table 2 or the complementary strand thereto, and/or cDNA contained in ATCC™ Deposit No:Z.

Further preferred is an isolated nucleic acid molecule comprising a nucleotide sequence which is at least 95% identical to a sequence of at least about 500 contiguous nucleotides in the nucleotide sequence of SEQ ID NO:X or the complementary strand thereto, the nucleotide sequence as defined in column 5 of Table 1B.1 or columns 8 and 9 of Table 2 or the complementary strand thereto, and/or cDNA contained in ATCC™ Deposit No:Z.

A further preferred embodiment is a nucleic acid molecule comprising a nucleotide sequence which is at least 95% identical to the nucleotide sequence of the portion of SEQ ID NO:X defined in column 5, "ORF (From-To)", in Table 1B.1.

A further preferred embodiment is a nucleic acid molecule comprising a nucleotide sequence which is at least 95% identical to the nucleotide sequence of the portion of SEQ ID NO:X defined in columns 8 and 9, "NT From" and "NT To", respectively, in Table 2.

A further preferred embodiment is an isolated nucleic acid molecule comprising a nucleotide sequence which is at least 95% identical to the complete nucleotide sequence of SEQ ID NO:X or the complementary strand thereto, the nucleotide sequence as defined in column 5 of Table 1B.1 or columns 8 and 9 of Table 2 or the complementary strand thereto, and/or cDNA contained in ATCC™ Deposit No:Z.

Also preferred is an isolated nucleic acid molecule which hybridizes under stringent hybridization conditions to a nucleic acid molecule comprising a nucleotide sequence of SEQ ID NO:X or the complementary strand thereto, the nucleotide sequence as defined in column 5 of Table 1B.1 or columns 8 and 9 of Table 2 or the complementary strand thereto, and/or cDNA contained in ATCC™ Deposit No:Z, wherein said nucleic acid molecule which hybridizes does not hybridize under stringent hybridization conditions to a nucleic acid molecule having a nucleotide sequence consisting of only A residues or of only T residues.

Also preferred is a composition of matter comprising a DNA molecule which comprises the cDNA contained in ATCC™ Deposit No:Z.

Also preferred is an isolated nucleic acid molecule comprising a nucleotide sequence which is at least 95% identical to a sequence of at least 50 contiguous nucleotides of the cDNA sequence contained in ATCC™ Deposit No:Z.

Also preferred is an isolated nucleic acid molecule, wherein said sequence of at least 50 contiguous nucleotides is included in the nucleotide sequence of an open reading frame sequence encoded by cDNA contained in ATCC™ Deposit No:Z.

Also preferred is an isolated nucleic acid molecule comprising a nucleotide sequence which is at least 95% identical to sequence of at least 150 contiguous nucleotides in the nucleotide sequence encoded by cDNA contained in ATCC™ Deposit No:Z.

A further preferred embodiment is an isolated nucleic acid molecule comprising a nucleotide sequence which is at least 95% identical to sequence of at least 500 contiguous nucleotides in the nucleotide sequence encoded by cDNA contained in ATCC™ Deposit No:Z.

A further preferred embodiment is an isolated nucleic acid molecule comprising a nucleotide sequence which is at least 95% identical to the complete nucleotide sequence encoded by cDNA contained in ATCC™ Deposit No:Z.

A further preferred embodiment is a method for detecting in a biological sample a nucleic acid molecule comprising a nucleotide sequence which is at least 95% identical to a sequence of at least 50 contiguous nucleotides in a sequence selected from the group consisting of: a nucleotide sequence of SEQ ID NO:X or the complementary strand thereto; the nucleotide sequence as defined in column 5 of Table 1B.1 or columns 8 and 9 of Table 2 or the complementary strand thereto; and a nucleotide sequence encoded by cDNA contained in ATCC™ Deposit No:Z; which method comprises a step of comparing a nucleotide sequence of at least one nucleic acid molecule in said sample with a sequence selected from said group and determining whether the sequence of said nucleic acid molecule in said sample is at least 95% identical to said selected sequence.

Also preferred is the above method wherein said step of comparing sequences comprises determining the extent of nucleic acid hybridization between nucleic acid molecules in said sample and a nucleic acid molecule comprising said sequence selected from said group. Similarly, also preferred is the above method wherein said step of comparing sequences is performed by comparing the nucleotide sequence determined from a nucleic acid molecule in said sample with said sequence selected from said group. The nucleic acid molecules can comprise DNA molecules or RNA molecules.

A further preferred embodiment is a method for identifying the species, tissue or cell type of a biological sample which method comprises a step of detecting nucleic acid molecules in said sample, if any, comprising a nucleotide sequence that is at least 95% identical to a sequence of at least 50 contiguous nucleotides in a sequence selected from the group consisting of: a nucleotide sequence of SEQ ID NO:X or the complementary strand thereto; the nucleotide sequence as defined in column 5 of Table 1B.1 or columns 8 and 9 of Table 2 or the complementary strand thereto; and a nucleotide sequence of the cDNA contained in ATCC™ Deposit No:Z.

The method for identifying the species, tissue or cell type of a biological sample can comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a method for diagnosing in a subject a pathological condition associated with abnormal structure or expression of a nucleotide sequence of SEQ ID NO:X or the complementary strand thereto; the nucleotide sequence as defined in column 5 of Table 1B.1 or columns 8 and 9 of Table 2 or the complementary strand thereto; or the cDNA contained in ATCC™ Deposit No:Z which encodes a protein, wherein the method comprises a step of detecting in a biological sample obtained from said subject nucleic acid molecules, if any, comprising a nucleotide sequence that is at least 95% identical to a sequence of at least 50 contiguous nucleotides in a sequence selected from the group consisting of: a nucleotide sequence of SEQ ID NO:X or the complementary strand thereto; the nucleotide sequence as defined in column 5 of Table 1B.1 or columns 8 and 9 of Table 2 or the complementary strand thereto; and a nucleotide sequence of cDNA contained in ATCC™ Deposit No:Z.

The method for diagnosing a pathological condition can comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a composition of matter comprising isolated nucleic acid molecules wherein the nucleotide sequences of said nucleic acid molecules comprise a panel of at least two nucleotide sequences, wherein at least one sequence in said panel is at least 95% identical to a sequence of at least 50 contiguous nucleotides in a sequence selected from the group consisting of: a nucleotide sequence of SEQ ID NO:X or the complementary strand thereto; the nucleotide sequence as defined in column 5 of Table 1B.1 or columns 8 and 9 of Table 2 or the complementary strand thereto; and a nucleotide sequence encoded by cDNA contained in ATCC™ Deposit No:Z. The nucleic acid molecules can comprise DNA molecules or RNA molecules.

Also preferred is a composition of matter comprising isolated nucleic acid molecules wherein the nucleotide sequences of said nucleic acid molecules comprise a DNA microarray or "chip" of at least 1, 2, 3, 4, 5, 6, 7, 8, 9, 10, 15, 20, 25, 30, 40, 50, 100, 150, 200, 250, 300, 500, 1000, 2000, 3000, or 4000 nucleotide sequences, wherein at least one sequence in said DNA microarray or "chip" is at least 95% identical to a sequence of at least 50 contiguous nucleotides in a sequence selected from the group consisting of: a nucleotide sequence of SEQ ID NO:X wherein X is any integer as defined in Table 1A and/or 1B; and a nucleotide sequence encoded by a human cDNA clone identified by a cDNA "Clone ID" in Table 1A and/or 1B.

Also preferred is an isolated polypeptide comprising an amino acid sequence at least 90% identical to a sequence of at least about 10 contiguous amino acids in the polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and/or a polypeptide encoded by cDNA contained in ATCC™ Deposit No:Z.

Also preferred is an isolated polypeptide comprising an amino acid sequence at least 95% identical to a sequence of at least about 30 contiguous amino acids in the amino acid sequence of SEQ ID NO:Y; a polypeptide encoded by SEQ ID NO:X or the complementary strand thereto; the polypeptide encoded by the nucleotide sequence as defined in columns 8 and 9 of Table 2; and/or a polypeptide encoded by cDNA contained in ATCC™ Deposit No:Z.

Further preferred is an isolated polypeptide comprising an amino acid sequence at least 95% identical to a sequence of at least about 100 contiguous amino acids in the amino acid sequence of SEQ ID NO:Y; a polypeptide encoded by SEQ ID NO:X or the complementary strand thereto; the polypeptide encoded by the nucleotide sequence as defined in columns 8 and 9 of Table 2; and/or a polypeptide encoded by cDNA contained in ATCC™ Deposit No:Z.

Further preferred is an isolated polypeptide comprising an amino acid sequence at least 95% identical to the complete amino acid sequence of SEQ ID NO:Y; a polypeptide encoded by SEQ ID NO:X or the complementary strand thereto; the polypeptide encoded by the nucleotide sequence as defined in columns 8 and 9 of Table 2; and/or a polypeptide encoded by cDNA contained in ATCC™ Deposit No:Z.

Further preferred is an isolated polypeptide comprising an amino acid sequence at least 90% identical to a sequence of at least about 10 contiguous amino acids in the complete amino acid sequence of a polypeptide encoded by contained in ATCC™ Deposit No:Z Also preferred is a polypeptide wherein said sequence of contiguous amino acids is included in the amino acid sequence of a portion of said polypeptide encoded by cDNA contained in ATCC™ Deposit No:Z; a polypeptide encoded by SEQ ID NO:X or the complementary strand thereto; the polypeptide encoded by the nucleotide sequence as defined in columns 8 and 9 of Table 2; and/or the polypeptide sequence of SEQ ID NO:Y.

Also preferred is an isolated polypeptide comprising an amino acid sequence at least 95% identical to a sequence of at least about 30 contiguous amino acids in the amino acid sequence of a polypeptide encoded by the cDNA contained in ATCC™ Deposit No:Z.

Also preferred is an isolated polypeptide comprising an amino acid sequence at least 95% identical to a sequence of at least about 100 contiguous amino acids in the amino acid sequence of a polypeptide encoded by cDNA contained in ATCC™ Deposit No:Z.

Also preferred is an isolated polypeptide comprising an amino acid sequence at least 95% identical to the amino acid sequence of a polypeptide encoded by the cDNA contained in ATCC™ Deposit No:Z.

Further preferred is an isolated antibody which binds specifically to a polypeptide comprising an amino acid sequence that is at least 90% identical to a sequence of at least 10 contiguous amino acids in a sequence selected from the group consisting of: a polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z.

Further preferred is a method for detecting in a biological sample a polypeptide comprising an amino acid sequence which is at least 90% identical to a sequence of at least 10 contiguous amino acids in a sequence selected from the group consisting of: a polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z; which method comprises a step of comparing an amino acid sequence of at least one polypeptide molecule in said sample with a sequence selected from said group and determining whether the sequence of said polypeptide molecule in said sample is at least 90% identical to said sequence of at least 10 contiguous amino acids.

Also preferred is the above method wherein said step of comparing an amino acid sequence of at least one polypeptide molecule in said sample with a sequence selected from said group comprises determining the extent of specific binding of polypeptides in said sample to an antibody which binds specifically to a polypeptide comprising an amino acid sequence that is at least 90% identical to a sequence of at least 10 contiguous amino acids in a sequence selected from the group consisting of: a polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z.

Also preferred is the above method wherein said step of comparing sequences is performed by comparing the amino acid sequence determined from a polypeptide molecule in said sample with said sequence selected from said group.

Also preferred is a method for identifying the species, tissue or cell type of a biological sample which method comprises a step of detecting polypeptide molecules in said sample, if any, comprising an amino acid sequence that is at least 90% identical to a sequence of at least 10 contiguous amino acids in a sequence selected from the group consisting of: polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z.

Also preferred is the above method for identifying the species, tissue or cell type of a biological sample, which method comprises a step of detecting polypeptide molecules comprising an amino acid sequence in a panel of at least two amino acid sequences, wherein at least one sequence in said panel is at least 90% identical to a sequence of at least 10 contiguous amino acids in a sequence selected from the above group.

Also preferred is a method for diagnosing in a subject a pathological condition associated with abnormal structure or expression of a nucleic acid sequence identified in Table 1A, 1B or Table 2 encoding a polypeptide, which method comprises a step of detecting in a biological sample obtained from said subject polypeptide molecules comprising an amino acid sequence in a panel of at least two amino acid sequences, wherein at least one sequence in said panel is at least 90% identical to a sequence of at least 10 contiguous amino acids in a sequence selected from the group consisting of: polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z.

In any of these methods, the step of detecting said polypeptide molecules includes using an antibody.

Also preferred is an isolated nucleic acid molecule comprising a nucleotide sequence which is at least 95% identical to a nucleotide sequence encoding a polypeptide wherein said polypeptide comprises an amino acid sequence that is at least 90% identical to a sequence of at least 10 contiguous amino acids in a sequence selected from the group consisting of: polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z.

Also preferred is an isolated nucleic acid molecule, wherein said nucleotide sequence encoding a polypeptide has been optimized for expression of said polypeptide in a prokaryotic host.

Also preferred is a polypeptide molecule, wherein said polypeptide comprises an amino acid sequence selected from the group consisting of: polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z.

Further preferred is a method of making a recombinant vector comprising inserting any of the above isolated nucleic acid molecule into a vector. Also preferred is the recombinant vector produced by this method. Also preferred is a method of making a recombinant host cell comprising introducing the vector into a host cell, as well as the recombinant host cell produced by this method.

Also preferred is a method of making an isolated polypeptide comprising culturing this recombinant host cell under conditions such that said polypeptide is expressed and recovering said polypeptide. Also preferred is this method of making an isolated polypeptide, wherein said recombinant host cell is a eukaryotic cell and said polypeptide is a human protein comprising an amino acid sequence selected from the group consisting of: polypeptide sequence of SEQ ID NO:Y; a polypeptide encoded by SEQ ID NO:X or the complementary strand thereto; the polypeptide encoded by the nucleotide sequence as defined in columns 8 and 9 of Table 2; and a polypeptide encoded by the cDNA contained in ATCC™ Deposit No:Z. The isolated polypeptide produced by this method is also preferred.

Also preferred is a method of treatment of an individual in need of an increased level of a protein activity, which method comprises administering to such an individual a Therapeutic comprising an amount of an isolated polypeptide, polynucleotide, immunogenic fragment or analogue thereof, binding agent, antibody, or antigen binding fragment of the claimed invention effective to increase the level of said protein activity in said individual.

Also preferred is a method of treatment of an individual in need of a decreased level of a protein activity, which method comprised administering to such an individual a Therapeutic comprising an amount of an isolated polypeptide, polynucleotide, immunogenic fragment or analogue thereof, binding agent, antibody, or antigen binding fragment of the claimed invention effective to decrease the level of said protein activity in said individual.

Also preferred is a method of treatment of an individual in need of a specific delivery of toxic compositions to diseased cells (e.g., tumors, leukemias or lymphomas), which method comprises administering to such an individual a Therapeutic comprising an amount of an isolated polypeptide of the invention, including, but not limited to a binding agent, or antibody of the claimed invention that are associated with toxin or cytotoxic prodrugs.

Having generally described the invention, the same will be more readily understood by reference to the following examples, which are provided by way of illustration and are not intended as limiting.

Description of Table 6

Table 6 summarizes some of the ATCC™ Deposits, Deposit dates, and ATCC™ designation numbers of deposits made with the ATCC™ in connection with the present application. These deposits were made in addition to those described in the Table 1A.

TABLE 6

| ATCC ™ Deposits | Deposit Date | ATCC ™ Designation Number |
|---|---|---|
| LP01, LP02, LP03, LP04, LP05, LP06, LP07, LP08, LP09, LP10, LP11, | May 20, 1997 | 209059, 209060, 209061, 209062, 209063, 209064, 209065, 209066, 209067, 209068, 209069 |
| LP12 | Jan. 12, 1998 | 209579 |
| LP13 | Jan. 12, 1998 | 209578 |
| LP14 | Jul. 16, 1998 | 203067 |
| LP15 | Jul. 16, 1998 | 203068 |
| LP16 | Feb. 1, 1999 | 203609 |
| LP17 | Feb. 1, 1999 | 203610 |
| LP20 | Nov. 17, 1998 | 203485 |
| LP21 | Jun. 18, 1999 | PTA-252 |
| LP22 | Jun. 18, 1999 | PTA-253 |
| LP23 | Dec. 22, 1999 | PTA-1081 |

EXAMPLES

Example 1

Isolation of a Selected cDNA Clone from the Deposited Sample

Each ATCC™ Deposit No:Z is contained in a plasmid vector. Table 7 identifies the vectors used to construct the cDNA library from which each clone was isolated. In many cases, the vector used to construct the library is a phage vector from which a plasmid has been excised. The following correlates the related plasmid for each phage vector used in constructing the cDNA library. For example, where a particular clone is identified in Table 7 as being isolated in the vector "Lambda Zap," the corresponding deposited clone is in "pBluescript."

| Vector Used to Construct Library | Corresponding Deposited Plasmid |
|---|---|
| Lambda Zap | pBluescript (pBS) |
| Uni-Zap XR | pBluescript (pBS) |
| Zap Express | pBK |
| lafmid BA | plafmid BA |
| pSport1 | pSport1 |
| pCMVSport 2.0 | pCMVSport 2.0 |
| pCMVSport 3.0 | pCMVSport 3.0 |
| pCR ® 2.1 | pCR ® 2.1 |

Vectors Lambda Zap (U.S. Pat. Nos. 5,128,256 and 5,286,636), Uni-Zap XR (U.S. Pat. Nos. 5,128,256 and 5,286,636), Zap Express (U.S. Pat. Nos. 5,128,256 and 5,286,636), pBluescript (pBS) (Short, J. M. et al., Nucleic Acids Res. 16:7583-7600 (1988); Alting-Mees, M. A. and Short, J. M., Nucleic Acids Res. 17:9494 (1989)) and pBK (Alting-Mees, M. A. et al., Strategies 5:58-61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Both can be transformed into E. coli strain XL-1 Blue, also available from Stratagene. pBS comes in 4 forms SK+, SK−, KS+ and KS. The S and K refers to the orientation of the polylinker to the T7 and T3 primer sequences which flank the polylinker region ("S" is for SacI and "K" is for KpnI which are the first sites on each respective end of the linker). "+" or "−" refer to the orientation of the f1 origin of replication ("ori"), such that in one orientation, single stranded rescue initiated from the f1 ori generates sense strand DNA and in the other, antisense.

Vectors pSport1, pCMVSport 2.0 and pCMVSport 3.0, were obtained from Life Technologies, Inc., P.O. Box 6009, Gaithersburg, Md. 20897. All Sport vectors contain an ampicillin resistance gene and may be transformed into E. coli strain DH10B, also available from Life Technologies. (See, for instance, Gruber, C. E., et al., Focus 15:59 (1993)). Vector lafmid BA (Bento Soares, Columbia University, NY) contains an ampicillin resistance gene and can be transformed into E. coli strain XL-1 Blue. Vector pCR®2.1, which is available from Invitrogen, 1600 Faraday Avenue, Carlsbad, Calif. 92008, contains an ampicillin resistance gene and may be transformed into E. coli strain DH10B, available from Life Technologies. (See, for instance, Clark, J. M., Nuc. Acids Res. 16:9677-9686 (1988) and Mead, D. et al., Bio/Technology 9: (1991)). Preferably, a polynucleotide of the present invention does not comprise the phage vector sequences identified for the particular clone in Table 7, as well as the corresponding plasmid vector sequences designated above.

The deposited material in the sample assigned the ATCC™ Deposit Number cited by reference to Tables 1, 2, 6 and 7 for any given cDNA clone also may contain one or more additional plasmids, each comprising a cDNA clone different from that given clone. Thus, deposits sharing the same ATCC™ Deposit Number contain at least a plasmid for each ATCC™ Deposit No:Z.

TABLE 7

| Libraries owned by Catalog | Catalog Description | Vector | ATCC ™ Deposit |
|---|---|---|---|
| HUKA HUKB HUKC HUKD HUKE HUKF HUKG | Human Uterine Cancer | Lambda ZAP II | LP01 |
| HCNA HCNB | Human Colon | Lambda Zap II | LP01 |
| HFFA | Human Fetal Brain, random primed | Lambda Zap II | LP01 |
| HTWA | Resting T-Cell | Lambda ZAP II | LP01 |
| HBQA | Early Stage Human Brain, random primed | Lambda ZAP II | LP01 |
| HLMB HLMF HLMG HLMH HLMI HLMJ HLMM HLMN | breast lymph node CDNA library | Lambda ZAP II | LP01 |
| HCQA HCQB | human colon cancer | Lamda ZAP II | LP01 |
| HMEA HMEC HMED HMEE HMEF HMEG HMEI HMEJ HMEK HMEL | Human Microvascular Endothelial Cells, fract. A | Lambda ZAP II | LP01 |
| HUSA HUSC | Human Umbilical Vein Endothelial Cells, fract. A | Lambda ZAP II | LP01 |
| HLQA HLQB | Hepatocellular Tumor | Lambda ZAP II | LP01 |
| HHGA HHGB HHGC HHGD | Hemangiopericytoma | Lambda ZAP II | LP01 |
| HSDM | Human Striatum Depression, re-rescue | Lambda ZAP II | LPO1 |
| HUSH | H Umbilical Vein Endothelial Cells, frac A, re-excision | Lambda ZAP II | LP01 |
| HSGS | Salivary gland, subtracted | Lambda ZAP II | LP01 |
| HFXA HFXB HFXC HFXD HFXE HFXF HFXG HFXH | Brain frontal cortex | Lambda ZAP II | LP01 |
| HPQA HPQB HPQC | PERM TF274 | Lambda ZAP II | LP01 |
| HFXJ HFXK | Brain Frontal Cortex, re-excision | Lambda ZAP II | LP01 |
| HCWA HCWB HCWC HCWD HCWE HCWF HCWG HCWH HCWI HCWJ HCWK | CD34 positive cells (Cord Blood) | ZAP Express | LP02 |
| HCUA HCUB HCUC | CD34 depleted Buffy Coat (Cord Blood) | ZAP Express | LP02 |
| HRSM | A-14 cell line | ZAP Express | LP02 |
| HRSA | A1-CELL LINE | ZAP Express | LP02 |
| HCUD HCUE HCUF HCUG HCUH HCUI | CD34 depleted Buffy Coat (Cord Blood), re-excision | ZAP Express | LP02 |
| HBXE HBXF HBXG | H. Whole Brain #2, re-excision | ZAP Express | LP02 |
| HRLM | L8 cell line | ZAP Express | LP02 |
| HBXA HBXB HBXC HBXD | Human Whole Brain #2 - Oligo dT > 1.5 Kb | ZAP Express | LP02 |
| HUDA HUDB HUDC | Testes | ZAP Express | LP02 |
| HHTM HHTN HHTO | H. hypothalamus, frac A; re-excision | ZAP Express | LP02 |
| HHTL | H. hypothalamus, frac A | ZAP Express | LP02 |
| HASA HASD | Human Adult Spleen | Uni-ZAP XR | LP03 |
| HFKC HFKD HFKE HFKF HFKG | Human Fetal Kidney | Uni-ZAP XR | LP03 |

TABLE 7-continued

| Libraries owned by Catalog | Catalog Description | Vector | ATCC ™ Deposit |
|---|---|---|---|
| HE8A HE8B HE8C HE8D HE8E HE8F HE8M HE8N | Human 8 Week Whole Embryo | Uni-ZAP XR | LP03 |
| HGBA HGBD HGBE HGBF HGBG HGBH HGBI | Human Gall Bladder | Uni-ZAP XR | LP03 |
| HLHA HLHB HLHC HLHD HLHE HLHF HLHG HLHH HLHQ | Human Fetal Lung III | Uni-ZAP XR | LP03 |
| HPMA HPMB HPMC HPMD HPME HPMF HPMG HPMH | Human Placenta | Uni-ZAP XR | LP03 |
| HPRA HPRB HPRC HPRD | Human Prostate | Uni-ZAP XR | LP03 |
| HSIA HSIC HSID HSIE | Human Adult Small Intestine | Uni-ZAP XR | LP03 |
| HTEA HTEB HTEC HTED HTEE HTEF HTEG HTEH HTEI HTEJ HTEK | Human Testes | Uni-ZAP XR | LP03 |
| HTPA HTPB HTPC HTPD HTPE | Human Pancreas Tumor | Uni-ZAP XR | LP03 |
| HTTA HTTB HTTC HTTD HTTE HTTF | Human Testes Tumor | Uni-ZAP XR | LP03 |
| HAPA HAPB HAPC HAPM | Human Adult Pulmonary | Uni-ZAP XR | LP03 |
| HETA HETB HETC HETD HETE HETF HETG HETH HETI | Human Endometrial Tumor | Uni-ZAP XR | LP03 |
| HHFB HHFC HHFD HHFE HHFF HHFG HHFH HHFI | Human Fetal Heart | Uni-ZAP XR | LP03 |
| HHPB HHPC HHPD HHPE HHPF HHPG HHPH | Human Hippocampus | Uni-ZAP XR | LP03 |
| HCE1 HCE2 HCE3 HCE4 HCE5 HCEB HCEC HCED HCEE HCEF HCEG | Human Cerebellum | Uni-ZAP XR | LP03 |
| HUVB HUVC HUVD HUVE | Human Umbilical Vein, Endo. remake | Uni-ZAP XR | LP03 |
| HSTA HSTB HSTC HSTD | Human Skin Tumor | Uni-ZAP XR | LP03 |
| HTAA HTAB HTAC HTAD HTAE | Human Activated T-Cells | Uni-ZAP XR | LP03 |
| HFEA HFEB HFEC | Human Fetal Epithelium (Skin) | Uni-ZAP XR | LP03 |
| HJPA HJPB HJPC HJPD | HUMAN JURKAT MEMBRANE BOUND POLYSOMES | Uni-ZAP XR | LP03 |
| HESA | Human epithelioid sarcoma | Uni-Zap XR | LP03 |
| HLTA HLTB HLTC HLTD HLTE HLTF | Human T-Cell Lymphoma | Uni-ZAP XR | LP03 |
| HFTA HFTB HFTC HFTD | Human Fetal Dura Mater | Uni-ZAP XR | LP03 |
| HRDA HRDB HRDC HRDD HRDE HRDF | Human Rhabdomyosarcoma | Uni-ZAP XR | LP03 |
| HCAA HCAB HCAC | Cem cells cyclohexamide treated | Uni-ZAP XR | LP03 |
| HRGA HRGB HRGC HRGD | Raji Cells, cyclohexamide treated | Uni-ZAP XR | LP03 |
| HSUA HSUB HSUC HSUM | Supt Cells, cyclohexamide treated | Uni-ZAP XR | LP03 |
| HT4A HT4C HT4D | Activated T-Cells, 12 hrs. | Uni-ZAP XR | LP03 |
| HE9A HE9B HE9C HE9D HE9E HE9F HE9G HE9H HE9M HE9N | Nine Week Old Early Stage Human | Uni-ZAP XR | LP03 |
| HATA HATB HATC HATD HATE | Human Adrenal Gland Tumor | Uni-ZAP XR | LP03 |
| HT5A | Activated T-Cells, 24 hrs. | Uni-ZAP XR | LP03 |
| HFGA HFGM | Human Fetal Brain | Uni-ZAP XR | LP03 |
| HNEA HNEB HNEC HNED HNEE | Human Neutrophil | Uni-ZAP XR | LP03 |
| HBGB HBGD | Human Primary Breast Cancer | Uni-ZAP XR | LP03 |
| HBNA HBNB | Human Normal Breast | Uni-ZAP XR | LP03 |
| HCAS | Cem Cells, cyclohexamide treated, subtra | Uni-ZAP XR | LP03 |
| HHPS | Human Hippocampus, subtracted | pBS | LP03 |
| HKCS HKCU | Human Colon Cancer, subtracted | pBS | LP03 |
| HRGS | Raji cells, cyclohexamide treated, subtracted | pBS | LP03 |
| HSUT | Supt cells, cyclohexamide treated, differentially expressed | pBS | LP03 |
| HT4S | Activated T-Cells, 12 hrs, subtracted | Uni-ZAP XR | LP03 |

TABLE 7-continued

| Libraries owned by Catalog | Catalog Description | Vector | ATCC ™ Deposit |
|---|---|---|---|
| HCDA HCDB HCDC HCDD HCDE | Human Chondrosarcoma | Uni-ZAP XR | LP03 |
| HOAA HOAB HOAC | Human Osteosarcoma | Uni-ZAP XR | LP03 |
| HTLA HTLB HTLC HTLD HTLE HTLF | Human adult testis, large inserts | Uni-ZAP XR | LP03 |
| HLMA HLMC HLMD | Breast Lymph node cDNA library | Uni-ZAP XR | LP03 |
| H6EA H6EB H6EC | HL-60, PMA 4H | Uni-ZAP XR | LP03 |
| HTXA HTXB HTXC HTXD HTXE HTXF HTXG HTXH | Activated T-Cell (12 hs)/Thiouridine labelledEco | Uni-ZAP XR | LP03 |
| HNFA HNFB HNFC HNFD HNFE HNFF HNFG HNFH HNFJ | Human Neutrophil, Activated | Uni-ZAP XR | LP03 |
| HTOB HTOC | HUMAN TONSILS, FRACTION 2 | Uni-ZAP XR | LP03 |
| HMGB | Human OB MG63 control fraction I | Uni-ZAP XR | LP03 |
| HOPB | Human OB HOS control fraction I | Uni-ZAP XR | LP03 |
| HORB | Human OB HOS treated (10 nM E2) fraction I | Uni-ZAP XR | LP03 |
| HSVA HSVB HSVC | Human Chronic Synovitis | Uni-ZAP XR | LP03 |
| HROA | HUMAN STOMACH | Uni-ZAP XR | LP03 |
| HBJA HBJB HBJC HBJD HBJE HBJF HBJG HBJH HBJI HBJJ HBJK | HUMAN B CELL LYMPHOMA | Uni-ZAP XR | LP03 |
| HCRA HCRB HCRC | human corpus colosum | Uni-ZAP XR | LP03 |
| HODA HODB HODC HODD | human ovarian cancer | Uni-ZAP XR | LP03 |
| HDSA | Dermatofibrosarcoma Protuberance | Uni-ZAP XR | LP03 |
| HMWA HMWB HMWC HMWD HMWE HMWF HMWG HMWH HMWI HMWJ | Bone Marrow Cell Line (RS4;11) | Uni-ZAP XR | LP03 |
| HSOA | stomach cancer (human) | Uni-ZAP XR | LP03 |
| HERA | SKIN | Uni-ZAP XR | LP03 |
| HMDA | Brain-medulloblastoma | Uni-ZAP XR | LP03 |
| HGLA HGLB HGLD | Glioblastoma | Uni-ZAP XR | LP03 |
| HEAA | H. Atrophic Endometrium | Uni-ZAP XR | LP03 |
| HBCA HBCB | H. Lymph node breast Cancer | Uni-ZAP XR | LP03 |
| HPWT | Human Prostate BPH, re-excision | Uni-ZAP XR | LP03 |
| HFVG HFVH HFVI | Fetal Liver, subtraction II | pBS | LP03 |
| HNFI | Human Neutrophils, Activated, re-excision | pBS | LP03 |
| HBMB HBMC HBMD | Human Bone Marrow, re-excision | pBS | LP03 |
| HKML HKMM HKMN | H. Kidney Medulla, re-excision | pBS | LP03 |
| HKIX HKIY | H. Kidney Cortex, subtracted | pBS | LP03 |
| HADT | H. Amygdala Depression, subtracted | pBS | LP03 |
| H6AS | Hl-60, untreated, subtracted | Uni-ZAP XR | LP03 |
| H6ES | HL-60, PMA 4 H, subtracted | Uni-ZAP XR | LP03 |
| H6BS | HL-60, RA 4 h, Subtracted | Uni-ZAP XR | LP03 |
| H6CS | HL-60, PMA 1 d, subtracted | Uni-ZAP XR | LP03 |
| HTXJ HTXK | Activated B cell(12 h)/Thiouridine-re-excision | Uni-ZAP XR | LP03 |
| HMSA HMSB HMSC HMSD HMSE HMSF HMSG HMSH HMSI HMSJ HMSK | Monocyte activated | Uni-ZAP XR | LP03 |
| HAGA HAGB HAGC HAGD HAGE HAGF | Human Amygdala | Uni-ZAP XR | LP03 |
| HSRA HSRB HSRE | STROMAL - OSTEOCLASTOMA | Uni-ZAP XR | LP03 |
| HSRD HSRF HSRG HSRH | Human Osteoclastoma Stromal Cells - unamplified | Uni-ZAP XR | LP03 |
| HSQA HSQB HSQC HSQD HSQE HSQF HSQG | Stromal cell TF274 | Uni-ZAP XR | LP03 |
| HSKA HSKB HSKC HSKD HSKE HSKF HSKZ | Smooth muscle, serum treated | Uni-ZAP XR | LP03 |
| HSLA HSLB HSLC HSLD HSLE HSLF HSLG | Smooth muscle, control | Uni-ZAP XR | LP03 |
| HSDA HSDD HSDE HSDF HSDG HSDH | Spinal cord | Uni-ZAP XR | LP03 |

TABLE 7-continued

| Libraries owned by Catalog | Catalog Description | Vector | ATCC ™ Deposit |
|---|---|---|---|
| HPWS | Prostate-BPH subtracted II | pBS | LP03 |
| HSKW HSKX HSKY | Smooth Muscle- HASTE normalized | pBS | LP03 |
| HFPB HFPC HFPD | H. Frontal cortex, epileptic; re-excision | Uni-ZAP XR | LP03 |
| HSDI HSDJ HSDK | Spinal Cord, re-excision | Uni-ZAP XR | LP03 |
| HSKN HSKO | Smooth Muscle Serum Treated, Norm | pBS | LP03 |
| HSKG HSKH HSKJ | Smooth muscle, serum induced, re-exc | pBS | LP03 |
| HFCA HFCB HFCC HFCD HFCE HFCF | Human Fetal Brain | Uni-ZAP XR | LP04 |
| HPTA HPTB HPTD | Human Pituitary | Uni-ZAP XR | LP04 |
| HTHB HTHC HTHD | Human Thymus | Uni-ZAP XR | LP04 |
| HE6B HE6C HE6D HE6E HE6F HE6G HE6S | Human Whole Six Week Old Embryo | Uni-ZAP XR | LP04 |
| HSSA HSSB HSSC HSSD HSSE HSSF HSSG HSSH HSSI HSSJ HSSK | Human Synovial Sarcoma | Uni-ZAP XR | LP04 |
| HE7T | 7 Week Old Early Stage Human, subtracted | Uni-ZAP XR | LP04 |
| HEPA HEPB HEPC | Human Epididymus | Uni-ZAP XR | LP04 |
| HSNA HSNB HSNC HSNM HSNN | Human Synovium | Uni-ZAP XR | LP04 |
| HPFB HPFC HPFD HPFE | Human Prostate Cancer, Stage C fraction | Uni-ZAP XR | LP04 |
| HE2A HE2D HE2E HE2H HE2I HE2M HE2N HE2O | 12 Week Old Early Stage Human | Uni-ZAP XR | LP04 |
| HE2B HE2C HE2F HE2G HE2P HE2Q | 12 Week Old Early Stage Human, II | Uni-ZAP XR | LP04 |
| HPTS HPTT HPTU | Human Pituitary, subtracted | Uni-ZAP XR | LP04 |
| HAUA HAUB HAUC | Amniotic Cells - TNF induced | Uni-ZAP XR | LP04 |
| HAQA HAQB HAQC HAQD | Amniotic Cells - Primary Culture | Uni-ZAP XR | LP04 |
| HWTA HWTB HWTC | wilm's tumor | Uni-ZAP XR | LP04 |
| HBSD | Bone Cancer, re-excision | Uni-ZAP XR | LP04 |
| HSGB | Salivary gland, re-excision | Uni-ZAP XR | LP04 |
| HSJA HSJB HSJC | Smooth muscle-ILb induced | Uni-ZAP XR | LP04 |
| HSXA HSXB HSXC HSXD | Human Substantia Nigra | Uni-ZAP XR | LP04 |
| HSHA HSHB HSHC | Smooth muscle, IL1b induced | Uni-ZAP XR | LP04 |
| HOUA HOUB HOUC HOUD HOUE | Adipocytes | Uni-ZAP XR | LP04 |
| HPWA HPWB HPWC HPWD HPWE | Prostate BPH | Uni-ZAP XR | LP04 |
| HELA HELB HELC HELD | Endothelial cells-control | Uni-ZAP XR | LP04 |
| HEMA HEMB HEMC HEMD HEME HEMF HEMG HEMH | Endothelial-induced | Uni-ZAP XR | LP04 |
| HBIA HBIB HBIC | Human Brain, Striatum | Uni-ZAP XR | LP04 |
| HHSA HHSB HHSC HHSD HHSE | Human Hypothalmus, Schizophrenia | Uni-ZAP XR | LP04 |
| HNGA HNGB HNGC HNGD HNGE HNGF HNGG HNGH HNGI HNGJ | neutrophils control | Uni-ZAP XR | LP04 |
| HNHA HNHB HNHC HNHD HNHE HNHF HNHG HNHH HNHI HNHJ | Neutrophils IL-1 and LPS induced | Uni-ZAP XR | LP04 |
| HSDB HSDC | STRIATUM DEPRESSION | Uni-ZAP XR | LP04 |
| HHPT | Hypothalamus | Uni-ZAP XR | LP04 |
| HSAT HSAU HSAV HSAW HSAX HSAY HSAZ | Anergic T-cell | Uni-ZAP XR | LP04 |
| HBMS HBMT HBMU HBMV HBMW HBMX | Bone marrow | Uni-ZAP XR | LP04 |
| HOEA HOEB HOEC HOED HOEE HOEF HOEJ | Osteoblasts | Uni-ZAP XR | LP04 |
| HAIA HAIB HAIC HAID HAIE HAIF | Epithelial-TNFa and INF induced | Uni-ZAP XR | LP04 |
| HTGA HTGB HTGC HTGD | Apoptotic T-cell | Uni-ZAP XR | LP04 |
| HMCA HMCB HMCC HMCD HMCE | Macrophage-oxLDL | Uni-ZAP XR | LP04 |
| HMAA HMAB HMAC HMAD HMAE HMAF HMAG | Macrophage (GM-CSF treated) | Uni-ZAP XR | LP04 |
| HPHA | Normal Prostate | Uni-ZAP XR | LP04 |
| HPIA HPIB HPIC | LNCAP prostate cell line | Uni-ZAP XR | LP04 |
| HPJA HPJB HPJC | PC3 Prostate cell line | Uni-ZAP XR | LP04 |

TABLE 7-continued

| Libraries owned by Catalog | Catalog Description | Vector | ATCC ™ Deposit |
|---|---|---|---|
| HOSE HOSF HOSG | Human Osteoclastoma, re-excision | Uni-ZAP XR | LP04 |
| HTGE HTGF | Apoptotic T-cell, re-excision | Uni-ZAP XR | LP04 |
| HMAJ HMAK | H Macrophage (GM-CSF treated), re-excision | Uni-ZAP XR | LP04 |
| HACB HACC HACD | Human Adipose Tissue, re-excision | Uni-ZAP XR | LP04 |
| HFPA | H. Frontal Cortex, Epileptic | Uni-ZAP XR | LP04 |
| HFAA HFAB HFAC HFAD HFAE | Alzheimer's, spongy change | Uni-ZAP XR | LP04 |
| HFAM | Frontal Lobe, Dementia | Uni-ZAP XR | LP04 |
| HMIA HMIB HMIC | Human Manic Depression Tissue | Uni-ZAP XR | LP04 |
| HTSA HTSE HTSF HTSG HTSH | Human Thymus | pBS | LP05 |
| HPBA HPBB HPBC HPBD HPBE | Human Pineal Gland | pBS | LP05 |
| HSAA HSAB HSAC | HSA 172 Cells | pBS | LP05 |
| HSBA HSBB HSBC HSBM | HSC 172 cells | pBS | LP05 |
| HJAA HJAB HJAC HJAD | Jurkat T-cell G1 phase | pBS | LP05 |
| HJBA HJBB HJBC HJBD | Jurkat T-Cell, S phase | pBS | LP05 |
| HAFA HAFB | Aorta endothelial cells + TNF-a | pBS | LP05 |
| HAWA HAWB HAWC | Human White Adipose | pBS | LP05 |
| HTNA HTNB | Human Thyroid | pBS | LP05 |
| HONA | Normal Ovary, Premenopausal | pBS | LP05 |
| HARA HARB | Human Adult Retina | pBS | LP05 |
| HLJA HLJB | Human Lung | pCMVSport 1 | LP06 |
| HOFM HOFN HOFO | H. Ovarian Tumor, II, OV5232 | pCMVSport 2.0 | LP07 |
| HOGA HOGB HOGC | OV 10-3-95 | pCMVSport 2.0 | LP07 |
| HCGL | CD34+ cells, II | pCMVSport 2.0 | LP07 |
| HDLA | Hodgkin's Lymphoma I | pCMVSport 2.0 | LP07 |
| HDTA HDTB HDTC HDTD HDTE | Hodgkin's Lymphoma II | pCMVSport 2.0 | LP07 |
| HKAA HKAB HKAC HKAD HKAE HKAF HKAG HKAH | Keratinocyte | pCMVSport 2.0 | LP07 |
| HCIM | CAPFINDER, Crohn's Disease, lib 2 | pCMVSport 2.0 | LP07 |
| HKAL | Keratinocyte, lib 2 | pCMVSport 2.0 | LP07 |
| HKAT | Keratinocyte, lib 3 | pCMVSport 2.0 | LP07 |
| HNDA | Nasal polyps | pCMVSport 2.0 | LP07 |
| HDRA | H. Primary Dendritic Cells, lib 3 | pCMVSport 2.0 | LP07 |
| HOHA HOHB HOHC | Human Osteoblasts II | pCMVSport 2.0 | LP07 |
| HLDA HLDB HLDC | Liver, Hepatoma | pCMVSport 3.0 | LP08 |
| HLDN HLDO HLDP | Human Liver, normal | pCMVSport 3.0 | LP08 |
| HMTA | pBMC stimulated w/ poly I/C | pCMVSport 3.0 | LP08 |
| HNTA | NTERA2, control | pCMVSport 3.0 | LP08 |
| HDPA HDPB HDPC HDPD HDPF HDPG HDPH HDPI HDPJ HDPK | Primary Dendritic Cells, lib 1 | pCMVSport 3.0 | LP08 |
| HDPM HDPN HDPO HDPP | Primary Dendritic cells, frac 2 | pCMVSport 3.0 | LP08 |
| HMUA HMUB HMUC | Myeloid Progenitor Cell Line | pCMVSport 3.0 | LP08 |
| HHEA HHEB HHEC HHED | T Cell helper I | pCMVSport 3.0 | LP08 |
| HHEM HHEN HHEO HHEP | T cell helper II | pCMVSport 3.0 | LP08 |
| HEQA HEQB HEQC | Human endometrial stromal cells | pCMVSport 3.0 | LP08 |
| HJMA HJMB | Human endometrial stromal cells-treated with progesterone | pCMVSport 3.0 | LP08 |
| HSWA HSWB HSWC | Human endometrial stromal cells-treated with estradiol | pCMVSport 3.0 | LP08 |
| HSYA HSYB HSYC | Human Thymus Stromal Cells | pCMVSport 3.0 | LP08 |
| HLWA HLWB HLWC | Human Placenta | pCMVSport 3.0 | LP08 |
| HRAA HRAB HRAC | Rejected Kidney, lib 4 | pCMVSport 3.0 | LP08 |
| HMTM | PCR, pBMC I/C treated | PCRII | LP09 |
| HMJA | H. Meniingima, M6 | pSport 1 | LP10 |
| HMKA HMKB HMKC HMKD HMKE | H. Meningima, M1 | pSport 1 | LP10 |
| HUSG HUSI | Human umbilical vein endothelial cells, IL-4 induced | pSport 1 | LP10 |
| HUSX HUSY | Human Umbilical Vein Endothelial Cells, uninduced | pSport 1 | LP10 |
| HOFA | Ovarian Tumor I, OV5232 | pSport 1 | LP10 |

TABLE 7-continued

| Libraries owned by Catalog | Catalog Description | Vector | ATCC ™ Deposit |
|---|---|---|---|
| HCFA HCFB HCFC HCFD | T-Cell PHA 16 hrs | pSport 1 | LP10 |
| HCFL HCFM HCFN HCFO | T-Cell PHA 24 hrs | pSport 1 | LP10 |
| HADA HADC HADD HADE HADF HADG | Human Adipose | pSport 1 | LP10 |
| HOVA HOVB HOVC | Human Ovary | pSport 1 | LP10 |
| HTWB HTWC HTWD HTWE HTWF | Resting T-Cell Library, II | pSport 1 | LP10 |
| HMMA | Spleen metastic melanoma | pSport 1 | LP10 |
| HLYA HLYB HLYC HLYD HLYE | Spleen, Chronic lymphocytic leukemia | pSport 1 | LP10 |
| HCGA | CD34+ cell, I | pSport 1 | LP10 |
| HEOM HEON | Human Eosinophils | pSport 1 | LP10 |
| HTDA | Human Tonsil, Lib 3 | pSport 1 | LP10 |
| HSPA | Salivary Gland, Lib 2 | pSport 1 | LP10 |
| HCHA HCHB HCHC | Breast Cancer cell line, MDA 36 | pSport 1 | LP10 |
| HCHM HCHN | Breast Cancer Cell line, angiogenic | pSport 1 | LP10 |
| HCIA | Crohn's Disease | pSport 1 | LP10 |
| HDAA HDAB HDAC | HEL cell line | Sport 1 | LP10 |
| HABA | Human Astrocyte | pSport 1 | LP10 |
| HUFA HUFB HUFC | Ulcerative Colitis | pSport 1 | LP10 |
| HNTM | NTERA2 + retinoic acid, 14 days | pSport 1 | LP10 |
| HDQA | Primary Dendritic cells, CapFinder2, frac 1 | pSport 1 | LP10 |
| HDQM | Primary Dendritic Cells, CapFinder, frac 2 | pSport 1 | LP10 |
| HLDX | Human Liver, normal, CapFinder | pSport 1 | LP10 |
| HULA HULB HULC | Human Dermal Endothelial Cells, untreated | pSport 1 | LP10 |
| HUMA | Human Dermal Endothelial cells, treated | pSport 1 | LP10 |
| HCJA | Human Stromal Endometrial fibroblasts, untreated | pSport 1 | LP10 |
| HCJM | Human Stromal endometrial fibroblasts, treated w/ estradiol | pSport 1 | LP10 |
| HEDA | Human Stromal endometrial fibroblasts, treated with progesterone | pSport 1 | LP10 |
| HFNA | Human ovary tumor cell OV350721 | pSport 1 | LP10 |
| HKGA HKGB HKGC HKGD | Merkel Cells | pSport 1 | LP10 |
| HISA HISB HISC | Pancreas Islet Cell Tumor | pSport 1 | LP10 |
| HLSA | Skin, burned | pSport 1 | LP10 |
| HBZA | Prostate, BPH, Lib 2 | pSport 1 | LP10 |
| HBZS | Prostate BPH, Lib 2, subtracted | pSport 1 | LP10 |
| HFIA HFIB HFIC | Synovial Fibroblasts (control) | pSport 1 | LP10 |
| HFIH HFII HFIJ | Synovial hypoxia | pSport 1 | LP10 |
| HFIT HFIU HFIV | Synovial IL-1/TNF stimulated | pSport 1 | LP10 |
| HGCA | Messangial cell, frac 1 | pSport 1 | LP10 |
| HMVA HMVB HMVC | Bone Marrow Stromal Cell, untreated | pSport 1 | LP10 |
| HFIX HFIY HFIZ | Synovial Fibroblasts (Il1/TNF), subt | pSport 1 | LP10 |
| HFOX HFOY HFOZ | Synovial hypoxia-RSF subtracted | pSport 1 | LP10 |
| HMQA HMQB HMQC HMQD | Human Activated Monocytes | Uni-ZAP XR | LP11 |
| HLIA HLIB HLIC | Human Liver | pCMVSport 1 | LP012 |
| HHBA HHBB HHBC HHBD HHBE | Human Heart | pCMVSport 1 | LP012 |
| HBBA HBBB | Human Brain | pCMVSport 1 | LP012 |
| HLJA HLJB HLJC HLJD HLJE | Human Lung | pCMVSport 1 | LP012 |
| HOGA HOGB HOGC | Ovarian Tumor | pCMVSport 2.0 | LP012 |
| HTJM | Human Tonsils, Lib 2 | pCMVSport 2.0 | LP012 |
| HAMF HAMG | KMH2 | pCMVSport 3.0 | LP012 |
| HAJA HAJB HAJC | L428 | pCMVSport 3.0 | LP012 |
| HWBA HWBB HWBC HWBD HWBE | Dendritic cells, pooled | pCMVSport 3.0 | LP012 |
| HWAA HWAB HWAC HWAD HWAE | Human Bone Marrow, treated | pCMVSport 3.0 | LP012 |
| HYAA HYAB HYAC | B Cell lymphoma | pCMVSport 3.0 | LP012 |

TABLE 7-continued

| Libraries owned by Catalog | Catalog Description | Vector | ATCC ™ Deposit |
|---|---|---|---|
| HWHG HWHH HWHI | Healing groin wound, 6.5 hours post incision | pCMVSport 3.0 | LP012 |
| HWHP HWHQ HWHR | Healing groin wound; 7.5 hours post incision | pCMVSport 3.0 | LP012 |
| HARM | Healing groin wound - zero hr post-incision (control) | pCMVSport 3.0 | LP012 |
| HBIM | Olfactory epithelium; nasalcavity | pCMVSport 3.0 | LP012 |
| HWDA | Healing Abdomen wound; 70 & 90 mm post incision | pCMVSport 3.0 | LP012 |
| HWEA | Healing Abdomen Wound; 15 days post incision | pCMVSport 3.0 | LP012 |
| HWJA | Healing Abdomen Wound; 21 & 29 days | pCMVSport 3.0 | LP012 |
| HNAL | Human Tongue, frac 2 | pSport 1 | LP012 |
| HMJA | H. Meniingima, M6 | pSport 1 | LP012 |
| HMKA HMKB HMKC HMKD HMKE | H. Meningima, M1 | pSport 1 | LP012 |
| HOFA | Ovarian Tumor I, OV5232 | pSport 1 | LP012 |
| HCFA HCFB HCFC HCFD | T-Cell PHA 16 hrs | pSport 1 | LP012 |
| HCFL HCFM HCFN HCFO | T-Cell PHA 24 hrs | pSport 1 | LP012 |
| HMMA HMMB HMMC | Spleen metastic melanoma | pSport 1 | LP012 |
| HTDA | Human Tonsil, Lib 3 | pSport 1 | LP012 |
| HDBA | Human Fetal Thymus | pSport 1 | LP012 |
| HDUA | Pericardium | pSport 1 | LP012 |
| HBZA | Prostate, BPH, Lib 2 | pSport 1 | LP012 |
| HWCA | Larynx tumor | pSport 1 | LP012 |
| HWKA | Normal lung | pSport 1 | LP012 |
| HSMB | Bone marrow stroma, treated | pSport 1 | LP012 |
| HBHM | Normal trachea | pSport 1 | LP012 |
| HLFC | Human Larynx | pSport 1 | LP012 |
| HLRB | Siebben Polyposis | pSport 1 | LP012 |
| HNIA | Mammary Gland | pSport 1 | LP012 |
| HNJB | Palate carcinoma | pSport 1 | LP012 |
| HNKA | Palate normal | pSport 1 | LP012 |
| HMZA | Pharynx carcinoma | pSport 1 | LP012 |
| HABG | Cheek Carcinoma | pSport 1 | LP012 |
| HMZM | Pharynx Carcinoma | pSport 1 | LP012 |
| HDRM | Larynx Carcinoma | pSport 1 | LP012 |
| HVAA | Pancreas normal PCA4 No | pSport 1 | LP012 |
| HICA | Tongue carcinoma | pSport 1 | LP012 |
| HUKA HUKB HUKC HUKD HUKE | Human Uterine Cancer | Lambda ZAP II | LP013 |
| HFFA | Human Fetal Brain, random primed | Lambda ZAP II | LP013 |
| HTUA | Activated T-cell labeled with 4-thioluri | Lambda ZAP II | LP013 |
| HBQA | Early Stage Human Brain, random primed | Lambda ZAP II | LP013 |
| HMEB | Human microvascular Endothelial cells, fract. B | Lambda ZAP II | LP013 |
| HUSH | Human Umbilical Vein Endothelial cells, fract. A, re-excision | Lambda ZAP II | LP013 |
| HLQC HLQD | Hepatocellular tumor, re-excision | Lambda ZAP II | LP013 |
| HTWJ HTWK HTWL | Resting T-cell, re-excision | Lambda ZAP II | LP013 |
| HF6S | Human Whole 6 week Old Embryo (II), subt | pBluescript | LP013 |
| HHPS | Human Hippocampus, subtracted | pBluescript | LP013 |
| HL1S | LNCAP, differential expression | pBluescript | LP013 |
| HLHS HLHT | Early Stage Human Lung, Subtracted | pBluescript | LP013 |
| HSUS | Supt cells, cyclohexamide treated, subtracted | pBluescript | LP013 |
| HSUT | Supt cells, cyclohexamide treated, differentially expressed | pBluescript | LP013 |
| HSDS | H. Striatum Depression, subtracted | pBluescript | LP013 |
| HPTZ | Human Pituitary, Subtracted VII | pBluescript | LP013 |
| HSDX | H. Striatum Depression, subt II | pBluescript | LP013 |
| HSDZ | H. Striatum Depression, subt | pBluescript | LP013 |

TABLE 7-continued

| Libraries owned by Catalog | Catalog Description | Vector | ATCC ™ Deposit |
|---|---|---|---|
| HPBA HPBB HPBC HPBD HPBE | Human Pineal Gland | pBluescript SK- | LP013 |
| HRTA | Colorectal Tumor | pBluescript SK- | LP013 |
| HSBA HSBB HSBC HSBM | HSC172 cells | pBluescript SK- | LP013 |
| HJAA HJAB HJAC HJAD | Jurkat T-cell G1 phase | pBluescript SK- | LP013 |
| HJBA HJBB HJBC HJBD | Jurkat T-cell, S1 phase | pBluescript SK- | LP013 |
| HTNA HTNB | Human Thyroid | pBluescript SK- | LP013 |
| HAHA HAHB | Human Adult Heart | Uni-ZAP XR | LP013 |
| HE6A | Whole 6 week Old Embryo | Uni-ZAP XR | LP013 |
| HFCA HFCB HFCC HFCD HFCE | Human Fetal Brain | Uni-ZAP XR | LP013 |
| HFKC HFKD HFKE HFKF HFKG | Human Fetal Kidney | Uni-ZAP XR | LP013 |
| HGBA HGBD HGBE HGBF HGBG | Human Gall Bladder | Uni-ZAP XR | LP013 |
| HPRA HPRB HPRC HPRD | Human Prostate | Uni-ZAP XR | LP013 |
| HTEA HTEB HTEC HTED HTEE | Human Testes | Uni-ZAP XR | LP013 |
| HTTA HTTB HTTC HTTD HTTE | Human Testes Tumor | Uni-ZAP XR | LP013 |
| HYBA HYBB | Human Fetal Bone | Uni-ZAP XR | LP013 |
| HFLA | Human Fetal Liver | Uni-ZAP XR | LP013 |
| HHFB HHFC HHFD HHFE HHFF | Human Fetal Heart | Uni-ZAP XR | LP013 |
| HUVB HUVC HUVD HUVE | Human Umbilical Vein, End. remake | Uni-ZAP XR | LP013 |
| HTHB HTHC HTHD | Human Thymus | Uni-ZAP XR | LP013 |
| HSTA HSTB HSTC HSTD | Human Skin Tumor | Uni-ZAP XR | LP013 |
| HTAA HTAB HTAC HTAD HTAE | Human Activated T-cells | Uni-ZAP XR | LP013 |
| HFEA HFEB HFEC | Human Fetal Epithelium (skin) | Uni-ZAP XR | LP013 |
| HJPA HJPB HJPC HJPD | Human Jurkat Membrane Bound Polysomes | Uni-ZAP XR | LP013 |
| HESA | Human Epithelioid Sarcoma | Uni-ZAP XR | LP013 |
| HALS | Human Adult Liver, Subtracted | Uni-ZAP XR | LP013 |
| HFTA HFTB HFTC HFTD | Human Fetal Dura Mater | Uni-ZAP XR | LP013 |
| HCAA HCAB HCAC | Cem cells, cyclohexamide treated | Uni-ZAP XR | LP013 |
| HRGA HRGB HRGC HRGD | Raji Cells, cyclohexamide treated | Uni-ZAP XR | LP013 |
| HE9A HE9B HE9C HE9D HE9E | Nine Week Old Early Stage Human | Uni-ZAP XR | LP013 |
| HSFA | Human Fibrosarcoma | Uni-ZAP XR | LP013 |
| HATA HATB HATC HATD HATE | Human Adrenal Gland Tumor | Uni-ZAP XR | LP013 |
| HTRA | Human Trachea Tumor | Uni-ZAP XR | LP013 |
| HE2A HE2D HE2E HE2H HE2I | 12 Week Old Early Stage Human | Uni-ZAP XR | LP013 |
| HE2B HE2C HE2F HE2G HE2P | 12 Week Old Early Stage Human, II | Uni-ZAP XR | LP013 |
| HNEA HNEB HNEC HNED HNEE | Human Neutrophil | Uni-ZAP XR | LP013 |
| HBGA | Human Primary Breast Cancer | Uni-ZAP XR | LP013 |
| HPTS HPTT HPTU | Human Pituitary, subtracted | Uni-ZAP XR | LP013 |
| HMQA HMQB HMQC HMQD | Human Activated Monocytes | Uni-ZAP XR | LP013 |
| HOAA HOAB HOAC | Human Osteosarcoma | Uni-ZAP XR | LP013 |
| HTOA HTOD HTOE HTOF HTOG | human tonsils | Uni-ZAP XR | LP013 |
| HMGB | Human OB MG63 control fraction I | Uni-ZAP XR | LP013 |
| HOPB | Human OB HOS control fraction I | Uni-ZAP XR | LP013 |
| HOQB | Human OB HOS treated (1 nM E2) fraction I | Uni-ZAP XR | LP013 |
| HAUA HAUB HAUC | Amniotic Cells - TNF induced | Uni-ZAP XR | LP013 |
| HAQA HAQB HAQC HAQD | Amniotic Cells - Primary Culture | Uni-ZAP XR | LP013 |
| HROA HROC | HUMAN STOMACH | Uni-ZAP XR | LP013 |
| HBJA HBJB HBJC HBJD HBJE | HUMAN B CELL LYMPHOMA | Uni-ZAP XR | LP013 |
| HODA HODB HODC HODD | human ovarian cancer | Uni-ZAP XR | LP013 |
| HCPA | Corpus Callosum | Uni-ZAP XR | LP013 |

TABLE 7-continued

| Libraries owned by Catalog | Catalog Description | Vector | ATCC ™ Deposit |
|---|---|---|---|
| HSOA | stomach cancer (human) | Uni-ZAP XR | LP013 |
| HERA | SKIN | Uni-ZAP XR | LP013 |
| HMDA | Brain-medulloblastoma | Uni-ZAP XR | LP013 |
| HGLA HGLB HGLD | Glioblastoma | Uni-ZAP XR | LP013 |
| HWTA HWTB HWTC | wilm's tumor | Uni-ZAP XR | LP013 |
| HEAA | H. Atrophic Endometrium | Uni-ZAP XR | LP013 |
| HAPN HAPO HAPP HAPQ HAPR | Human Adult Pulmonary; re-excision | Uni-ZAP XR | LP013 |
| HLTG HLTH | Human T-cell lymphoma; re-excision | Uni-ZAP XR | LP013 |
| HAHC HAHD HAHE | Human Adult Heart; re-excision | Uni-ZAP XR | LP013 |
| HAGA HAGB HAGC HAGD HAGE | Human Amygdala | Uni-ZAP XR | LP013 |
| HSJA HSJB HSJC | Smooth muscle-ILb induced | Uni-ZAP XR | LP013 |
| HSHA HSHB HSHC | Smooth muscle, IL1b induced | Uni-ZAP XR | LP013 |
| HPWA HPWB HPWC HPWD HPWE | Prostate BPH | Uni-ZAP XR | LP013 |
| HPIA HPIB HPIC | LNCAP prostate cell line | Uni-ZAP XR | LP013 |
| HPJA HPJB HPJC | PC3 Prostate cell line | Uni-ZAP XR | LP013 |
| HBTA | Bone Marrow Stroma, TNF & LPS ind | Uni-ZAP XR | LP013 |
| HMCF HMCG HMCH HMCI HMCJ | Macrophage-oxLDL; re-excision | Uni-ZAP XR | LP013 |
| HAGG HAGH HAGI | Human Amygdala; re-excision | Uni-ZAP XR | LP013 |
| HACA | H. Adipose Tissue | Uni-ZAP XR | LP013 |
| HKFB | K562 + PMA (36 hrs), re-excision | ZAP Express | LP013 |
| HCWT HCWU HCWV | CD34 positive cells (cord blood), re-ex | ZAP Express | LP013 |
| HBWA | Whole brain | ZAP Express | LP013 |
| HBXA HBXB HBXC HBXD | Human Whole Brain #2 - Oligo dT > 1.5 Kb | ZAP Express | LP013 |
| HAVM | Temporal cortex-Alzheizmer | pT-Adv | LP014 |
| HAVT | Hippocampus, Alzheimer Subtracted | pT-Adv | LP014 |
| HHAS | CHME Cell Line | Uni-ZAP XR | LP014 |
| HAJR | Larynx normal | pSport 1 | LP014 |
| HWLE HWLF HWLG HWLH | Colon Normal | pSport 1 | LP014 |
| HCRM HCRN HCRO | Colon Carcinoma | pSport 1 | LP014 |
| HWLI HWLJ HWLK | Colon Normal | pSport 1 | LP014 |
| HWLQ HWLR HWLS HWLT | Colon Tumor | pSport 1 | LP014 |
| HBFM | Gastrocnemius Muscle | pSport 1 | LP014 |
| HBOD HBOE | Quadriceps Muscle | pSport 1 | LP014 |
| HBKD HBKE | Soleus Muscle | pSport 1 | LP014 |
| HCCM | Pancreatic Langerhans | pSport 1 | LP014 |
| HWGA | Larynx carcinoma | pSport 1 | LP014 |
| HWGM HWGN | Larynx carcinoma | pSport 1 | LP014 |
| HWLA HWLB HWLC | Normal colon | pSport 1 | LP014 |
| HWLM HWLN | Colon Tumor | pSport 1 | LP014 |
| HVAM HVAN HVAO | Pancreas Tumor | pSport 1 | LP014 |
| HWGQ | Larynx carcinoma | pSport 1 | LP014 |
| HAQM HAQN | Salivary Gland | pSport 1 | LP014 |
| HASM | Stomach; normal | pSport 1 | LP014 |
| HBCM | Uterus; normal | pSport 1 | LP014 |
| HCDM | Testis; normal | pSport 1 | LP014 |
| HDJM | Brain; normal | pSport 1 | LP014 |
| HEFM | Adrenal Gland, normal | pSport 1 | LP014 |
| HBAA | Rectum normal | pSport 1 | LP014 |
| HFDM | Rectum tumour | pSport 1 | LP014 |
| HGAM | Colon, normal | pSport 1 | LP014 |
| HHMM | Colon, tumour | pSport 1 | LP014 |
| HCLB HCLC | Human Lung Cancer | Lambda Zap II | LP015 |
| HRLA | L1 Cell line | ZAP Express | LP015 |
| HHAM | Hypothalamus, Alzheimer's | pCMVSport 3.0 | LP015 |
| HKBA | Ku 812F Basophils Line | pSport 1 | LP015 |
| HS2S | Saos2, Dexamethosome Treated | pSport 1 | LP016 |
| HA5A | Lung Carcinoma A549 TNFalpha activated | pSport 1 | LP016 |
| HTFM | TF-1 Cell Line GM-CSF Treated | pSport 1 | LP016 |
| HYAS | Thyroid Tumour | pSport 1 | LP016 |
| HUTS | Larynx Normal | pSport 1 | LP016 |
| HXOA | Larynx Tumor | pSport 1 | LP016 |

TABLE 7-continued

| Libraries owned by Catalog | Catalog Description | Vector | ATCC ™ Deposit |
|---|---|---|---|
| HEAH | Ea.hy.926 cell line | pSport 1 | LP016 |
| HINA | Adenocarcinoma Human | pSport 1 | LP016 |
| HRMA | Lung Mesothelium | pSport 1 | LP016 |
| HLCL | Human Pre-Differentiated Adipocytes | Uni-Zap XR | LP017 |
| HS2A | Saos2 Cells | pSport 1 | LP020 |
| HS2I | Saos2 Cells; Vitamin D3 Treated | pSport 1 | LP020 |
| HUCM | CHME Cell Line, untreated | pSport 1 | LP020 |
| HEPN | Aryepiglottis Normal | pSport 1 | LP020 |
| HPSN | Sinus Piniformis Tumour | pSport 1 | LP020 |
| HNSA | Stomach Normal | pSport 1 | LP020 |
| HNSM | Stomach Tumour | pSport 1 | LP020 |
| HNLA | Liver Normal Met5No | pSport 1 | LP020 |
| HUTA | Liver Tumour Met 5 Tu | pSport 1 | LP020 |
| HOCN | Colon Normal | pSport 1 | LP020 |
| HOCT | Colon Tumor | pSport 1 | LP020 |
| HTNT | Tongue Tumour | pSport 1 | LP020 |
| HLXN | Larynx Normal | pSport 1 | LP020 |
| HLXT | Larynx Tumour | pSport 1 | LP020 |
| HTYN | Thymus | pSport 1 | LP020 |
| HPLN | Placenta | pSport 1 | LP020 |
| HTNG | Tongue Normal | pSport 1 | LP020 |
| HZAA | Thyroid Normal (SDCA2 No) | pSport 1 | LP020 |
| HWES | Thyroid Thyroiditis | pSport 1 | LP020 |
| HFHD | Ficolled Human Stromal Cells, 5Fu treated | pTrip1Ex2 | LP021 |
| HFHM, HFHN | Ficolled Human Stromal Cells, Untreated | pTrip1Ex2 | LP021 |
| HPCI | Hep G2 Cells, lambda library | lambda Zap-CMV XR | LP021 |
| HBCA, HBCB, HBCC | H. Lymph node breast Cancer | Uni-ZAP XR | LP021 |
| HCOK | Chondrocytes | pSPORT 1 | LP022 |
| HDCA, HDCB, HDCC | Dendritic Cells From CD34 Cells | pSPORT 1 | LP022 |
| HDMA, HDMB | CD40 activated monocyte dendritic cells | pSPORT 1 | LP022 |
| HDDM, HDDN, HDDO | LPS activated derived dendritic cells | pSPORT 1 | LP022 |
| HPCR | Hep G2 Cells, PCR library | lambda Zap-CMV XR | LP022 |
| HAAA, HAAB, HAAC | Lung, Cancer (4005313A3): Invasive Poorly Differentiated Lung Adenocarcinoma | pSPORT 1 | LP022 |
| HIPA, HIPB, HIPC | Lung, Cancer (4005163 B7): Invasive, Poorly Diff. Adenocarcinoma, Metastatic | pSPORT 1 | LP022 |
| HOOH, HOOI | Ovary, Cancer: (4004562 B6) Papillary Serous Cystic Neoplasm, Low Malignant Pot | pSPORT1 | LP022 |
| HIDA | Lung, Normal: (4005313 B1) | pSPORT 1 | LP022 |
| HUJA, HUJB, HUJC, HUJD, HUJE | B-Cells | pCMVSport 3.0 | LP022 |
| HNOA, HNOB, HNOC, HNOD | Ovary, Normal: (9805C040R) | pSPORT 1 | LP022 |
| HNLM | Lung, Normal: (4005313 B1) | pSPORT 1 | LP022 |
| HSCL | Stromal Cells | pSPORT 1 | LP022 |
| HAAX | Lung, Cancer: (4005313 A3) Invasive Poorly-differentiated Metastatic lung adenocarcinoma | pSPORT 1 | LP022 |
| HUUA, HUUB, HUUC, HUUD | B-cells (unstimulated) | pTrip1Ex2 | LP022 |
| HWWA, HWWB, HWWC, HWWD, HWWE, HWWF, HWWG | B-cells (stimulated) | pSPORT 1 | LP022 |
| HCCC | Colon, Cancer: (9808C064R) | pCMVSport 3.0 | LP023 |
| HPDO HPDP HPDQ HPDR HPD | Ovary, Cancer (9809C332): Poorly differentiated adenocarcinoma | pSport 1 | LP023 |
| HPCO HPCP HPCQ HPCT | Ovary, Cancer (15395A1F): Grade II Papillary Carcinoma | pSport 1 | LP023 |
| HOCM HOCO HOCP HOCQ | Ovary, Cancer: (15799A1F) Poorly differentiated carcinoma | pSport 1 | LP023 |
| HCBM HCBN HCBO | Breast, Cancer: (4004943 A5) | pSport 1 | LP023 |
| HNBT HNBU HNBV | Breast, Normal: (4005522B2) | pSport 1 | LP023 |
| HBCP HBCQ | Breast, Cancer: (4005522 A2) | pSport 1 | LP023 |
| HBCJ | Breast, Cancer: (9806C012R) | pSport 1 | LP023 |

TABLE 7-continued

| Libraries owned by Catalog | Catalog Description | Vector | ATCC ™ Deposit |
|---|---|---|---|
| HSAM HSAN | Stromal cells 3.88 | pSport 1 | LP023 |
| HVCA HVCB HVCC HVCD | Ovary, Cancer: (4004332 A2) | pSport 1 | LP023 |
| HSCK HSEN HSEO | Stromal cells (HBM3.18) | pSport 1 | LP023 |
| HSCP HSCQ | stromal cell clone 2.5 | pSport 1 | LP023 |
| HUXA | Breast Cancer: (4005385 A2) | pSport 1 | LP023 |
| HCOM HCON HCOO HCOP HCOQ | Ovary, Cancer (4004650 A3): Well-Differentiated Micropapillary Serous Carcinoma | pSport 1 | LP023 |
| HBNM | Breast, Cancer: (9802C020E) | pSport 1 | LP023 |
| HVVA HVVB HVVC HVVD HVVE | Human Bone Marrow, treated | pSport 1 | LP023 |

Two nonlimiting examples are provided below for isolating a particular clone from the deposited sample of plasmid cDNAs cited for that clone in Table 7. First, a plasmid is directly isolated by screening the clones using a polynucleotide probe corresponding to the nucleotide sequence of SEQ ID NO:X.

Particularly, a specific polynucleotide with 30-40 nucleotides is synthesized using an Applied Biosystems DNA synthesizer according to the sequence reported. The oligonucleotide is labeled, for instance, with $^{32}$P-γ-ATP using T4 polynucleotide kinase and purified according to routine methods. (E.g., Maniatis et al., Molecular Cloning: A Laboratory Manual, Cold Spring Harbor Press, Cold Spring, N.Y. (1982)). The plasmid mixture is transformed into a suitable host, as indicated above (such as XL-1 Blue (Stratagene)) using techniques known to those of skill in the art, such as those provided by the vector supplier or in related publications or patents cited above. The transformants are plated on 1.5% agar plates (containing the appropriate selection agent, e.g., ampicillin) to a density of about 150 transformants (colonies) per plate. These plates are screened using Nylon membranes according to routine methods for bacterial colony screening (e.g., Sambrook et al., Molecular Cloning: A Laboratory Manual, 2nd Edit., (1989), Cold Spring Harbor Laboratory Press, pages 1.93 to 1.104), or other techniques known to those of skill in the art.

Alternatively, two primers of 17-20 nucleotides derived from both ends of the nucleotide sequence of SEQ ID NO:X are synthesized and used to amplify the desired cDNA using the deposited cDNA plasmid as a template. The polymerase chain reaction is carried out under routine conditions, for instance, in 25 µl of reaction mixture with 0.5 ug of the above cDNA template. A convenient reaction mixture is 1.5-5 mM $MgCl_2$, 0.01% (w/v) gelatin, 20 µM each of dATP, dCTP, dGTP, dTTP, 25 pmol of each primer and 0.25 Unit of Taq polymerase. Thirty five cycles of PCR (denaturation at 94° C. for 1 min; annealing at 55° C. for 1 min; elongation at 72° C. for 1 min) are performed with a Perkin-Elmer Cetus automated thermal cycler. The amplified product is analyzed by agarose gel electrophoresis and the DNA band with expected molecular weight is excised and purified. The PCR product is verified to be the selected sequence by subcloning and sequencing the DNA product.

Several methods are available for the identification of the 5' or 3' non-coding portions of a gene which may not be present in the deposited clone. These methods include but are not limited to, filter probing, clone enrichment using specific probes, and protocols similar or identical to 5' and 3' "RACE" protocols which are well known in the art. For instance, a method similar to 5' RACE is available for generating the missing 5' end of a desired full-length transcript. (Fromont-Racine et al., Nucleic Acids Res. 21(7):1683-1684 (1993)).

Briefly, a specific RNA oligonucleotide is ligated to the 5' ends of a population of RNA presumably containing full-length gene RNA transcripts. A primer set containing a primer specific to the ligated RNA oligonucleotide and a primer specific to a known sequence of the gene of interest is used to PCR amplify the 5' portion of the desired full-length gene. This amplified product may then be sequenced and used to generate the full length gene.

This above method starts with total RNA isolated from the desired source, although poly-A+ RNA can be used. The RNA preparation can then be treated with phosphatase if necessary to eliminate 5' phosphate groups on degraded or damaged RNA which may interfere with the later RNA ligase step. The phosphatase should then be inactivated and the RNA treated with tobacco acid pyrophosphatase in order to remove the cap structure present at the 5' ends of messenger RNAs. This reaction leaves a 5' phosphate group at the 5' end of the cap cleaved RNA which can then be ligated to an RNA oligonucleotide using T4 RNA ligase.

This modified RNA preparation is used as a template for first strand cDNA synthesis using a gene specific oligonucleotide. The first strand synthesis reaction is used as a template for PCR amplification of the desired 5' end using a primer specific to the ligated RNA oligonucleotide and a primer specific to the known sequence of the gene of interest. The resultant product is then sequenced and analyzed to confirm that the 5' end sequence belongs to the desired gene.

Example 2

Isolation of Genomic Clones Corresponding to a Polynucleotide

A human genomic P1 library (Genomic Systems, Inc.) is screened by PCR using primers selected for the sequence corresponding to SEQ ID NO:X according to the method described in Example 1. (See also, Sambrook.)

Example 3

Tissue Specific Expression Analysis

The Human Genome Sciences, Inc. (HGS) database is derived from sequencing tissue and/or disease specific cDNA libraries. Libraries generated from a particular tissue are selected and the specific tissue expression pattern of EST groups or assembled contigs within these libraries is determined by comparison of the expression patterns of those groups or contigs within the entire database. ESTs and assembled contigs which show tissue specific expression are selected.

The original clone from which the specific EST sequence was generated, or in the case of an assembled contig, the clone from which the 5' most EST sequence was generated, is obtained from the catalogued library of clones and the insert amplified by PCR using methods known in the art. The PCR product is denatured and then transferred in 96 or 384 well format to a nylon membrane (Schleicher and Scheull) generating an array filter of tissue specific clones. Housekeeping genes, maize genes, and known tissue specific genes are included on the filters. These targets can be used in signal normalization and to validate assay sensitivity. Additional targets are included to monitor probe length and specificity of hybridization.

Radioactively labeled hybridization probes are generated by first strand cDNA synthesis per the manufacturer's instructions (Life Technologies) from mRNA/RNA samples prepared from the specific tissue being analyzed (e.g., prostate, prostate cancer, ovarian, ovarian cancer, etc.). The hybridization probes are purified by gel exclusion chromatography, quantitated, and hybridized with the array filters in hybridization bottles at 65° C. overnight. The filters are washed under stringent conditions and signals are captured using a Fuji phosphorimager.

Data is extracted using AIS software and following background subtraction, signal normalization is performed. This includes a normalization of filter-wide expression levels between different experimental runs. Genes that are differentially expressed in the tissue of interest are identified.

Example 4

Chromosomal Mapping of the Polynucleotides

An oligonucleotide primer set is designed according to the sequence at the 5' end of SEQ ID NO:X. This primer preferably spans about 100 nucleotides. This primer set is then used in a polymerase chain reaction under the following set of conditions: 30 seconds, 95° C.; 1 minute, 56° C.; 1 minute, 70° C. This cycle is repeated 32 times followed by one 5 minute cycle at 70° C. Human, mouse, and hamster DNA is used as template in addition to a somatic cell hybrid panel containing individual chromosomes or chromosome fragments (Bios, Inc). The reactions are analyzed on either 8% polyacrylamide gels or 3.5% agarose gels. Chromosome mapping is determined by the presence of an approximately 100 bp PCR fragment in the particular somatic cell hybrid.

Example 5

Bacterial Expression of a Polypeptide

A polynucleotide encoding a polypeptide of the present invention is amplified using PCR oligonucleotide primers corresponding to the 5' and 3' ends of the DNA sequence, as outlined in Example 1, to synthesize insertion fragments. The primers used to amplify the cDNA insert should preferably contain restriction sites, such as BamHI and XbaI, at the 5' end of the primers in order to clone the amplified product into the expression vector. For example, BamHI and XbaI correspond to the restriction enzyme sites on the bacterial expression vector pQE-9. (Qiagen, Inc., Chatsworth, Calif.). This plasmid vector encodes antibiotic resistance (Ampr), a bacterial origin of replication (ori), an IPTG-regulatable promoter/operator (P/O), a ribosome binding site (RBS), a 6-histidine tag (6-His), and restriction enzyme cloning sites.

The pQE-9 vector is digested with BamHI and XbaI and the amplified fragment is ligated into the pQE-9 vector maintaining the reading frame initiated at the bacterial RBS. The ligation mixture is then used to transform the E. coli strain M15/rep4 (Qiagen, Inc.) which contains multiple copies of the plasmid pREP4, which expresses the lacI repressor and also confers kanamycin resistance (Kan$^r$). Transformants are identified by their ability to grow on LB plates and ampicillin/kanamycin resistant colonies are selected. Plasmid DNA is isolated and confirmed by restriction analysis.

Clones containing the desired constructs are grown overnight (O/N) in liquid culture in LB media supplemented with both Amp (100 ug/ml) and Kan (25 ug/ml). The O/N culture is used to inoculate a large culture at a ratio of 1:100 to 1:250. The cells are grown to an optical density 600 (O.D.$^{600}$) of between 0.4 and 0.6. IPTG (Isopropyl-B-D-thiogalacto pyranoside) is then added to a final concentration of 1 mM. IPTG induces by inactivating the lacI repressor, clearing the P/O leading to increased gene expression.

Cells are grown for an extra 3 to 4 hours. Cells are then harvested by centrifugation (20 mins at 6000×g). The cell pellet is solubilized in the chaotropic agent 6 Molar Guanidine HCl by stirring for 3-4 hours at 4° C. The cell debris is removed by centrifugation, and the supernatant containing the polypeptide is loaded onto a nickel-nitrilo-tri-acetic acid ("Ni-NTA") affinity resin column (available from QIAGEN, Inc., supra). Proteins with a 6×His tag bind to the Ni-NTA resin with high affinity and can be purified in a simple one-step procedure (for details see: The QIAexpressionist (1995) QIAGEN, Inc., supra).

Briefly, the supernatant is loaded onto the column in 6 M guanidine-HCl, pH 8. The column is first washed with 10 volumes of 6 M guanidine-HCl, pH 8, then washed with 10 volumes of 6 M guanidine-HCl pH 6, and finally the polypeptide is eluted with 6 M guanidine-HCl, pH 5.

The purified protein is then renatured by dialyzing it against phosphate-buffered saline (PBS) or 50 mM Na-acetate, pH 6 buffer plus 200 mM NaCl. Alternatively, the protein can be successfully refolded while immobilized on the Ni-NTA column. The recommended conditions are as follows: renature using a linear 6M-1M urea gradient in 500 mM NaCl, 20% glycerol, 20 mM Tris/HCl pH 7.4, containing protease inhibitors. The renaturation should be performed over a period of 1.5 hours or more. After renaturation the proteins are eluted by the addition of 250 mM immidazole. Immidazole is removed by a final dialyzing step against PBS or 50 mM sodium acetate pH 6 buffer plus 200 mM NaCl. The purified protein is stored at 4° C. or frozen at −80° C.

In addition to the above expression vector, the present invention further includes an expression vector, called pHE4a (ATCC™ Accession Number 209645, deposited on Feb. 25, 1998) which contains phage operator and promoter elements operatively linked to a polynucleotide of the present invention, called pHE4a. (ATCC™ Accession Number 209645, deposited on Feb. 25, 1998.) This vector contains: 1) a neomycinphosphotransferase gene as a selection marker, 2) an E. coli origin of replication, 3) a T5 phage promoter sequence, 4) two lac operator sequences, 5) a Shine-Delgarno sequence, and 6) the lactose operon repressor gene (lacIq). The origin of replication (oriC) is derived from pUC19 (LTI, Gaithersburg, Md.). The promoter and operator sequences are made synthetically.

DNA can be inserted into the pHE4a by restricting the vector with NdeI and XbaI, BamHI, XhoI, or Asp718, running the restricted product on a gel, and isolating the larger fragment (the stuffer fragment should be about 310 base pairs). The DNA insert is generated according to the PCR protocol described in Example 1, using PCR primers having restriction sites for NdeI (5' primer) and XbaI, BamHI, XhoI, or Asp718 (3' primer). The PCR insert is gel purified and restricted with compatible enzymes. The insert and vector are ligated according to standard protocols.

The engineered vector could easily be substituted in the above protocol to express protein in a bacterial system.

Example 6

Purification of a Polypeptide from an Inclusion Body

The following alternative method can be used to purify a polypeptide expressed in *E coli* when it is present in the form of inclusion bodies. Unless otherwise specified, all of the following steps are conducted at 4-10° C.

Upon completion of the production phase of the *E. coli* fermentation, the cell culture is cooled to 4-10° C. and the cells harvested by continuous centrifugation at 15,000 rpm (Heraeus Sepatech). On the basis of the expected yield of protein per unit weight of cell paste and the amount of purified protein required, an appropriate amount of cell paste, by weight, is suspended in a buffer solution containing 100 mM Tris, 50 mM EDTA, pH 7.4. The cells are dispersed to a homogeneous suspension using a high shear mixer.

The cells are then lysed by passing the solution through a microfluidizer (Microfuidics, Corp. or APV Gaulin, Inc.) twice at 4000-6000 psi. The homogenate is then mixed with NaCl solution to a final concentration of 0.5 M NaCl, followed by centrifugation at 7000×g for 15 min. The resultant pellet is washed again using 0.5M NaCl, 100 mM Tris, 50 mM EDTA, pH 7.4.

The resulting washed inclusion bodies are solubilized with 1.5 M guanidine hydrochloride (GuHCl) for 2-4 hours. After 7000×g centrifugation for 15 min., the pellet is discarded and the polypeptide containing supernatant is incubated at 4° C. overnight to allow further GuHCl extraction.

Following high speed centrifugation (30,000×g) to remove insoluble particles, the GuHCl solubilized protein is refolded by quickly mixing the GuHCl extract with 20 volumes of buffer containing 50 mM sodium, pH 4.5, 150 mM NaCl, 2 mM EDTA by vigorous stirring. The refolded diluted protein solution is kept at 4° C. without mixing for 12 hours prior to further purification steps.

To clarify the refolded polypeptide solution, a previously prepared tangential filtration unit equipped with 0.16 µm membrane filter with appropriate surface area (e.g., Filtron), equilibrated with 40 mM sodium acetate, pH 6.0 is employed. The filtered sample is loaded onto a cation exchange resin (e.g., Poros HS-50, Perseptive Biosystems). The column is washed with 40 mM sodium acetate, pH 6.0 and eluted with 250 mM, 500 mM, 1000 mM, and 1500 mM NaCl in the same buffer, in a stepwise manner. The absorbance at 280 nm of the effluent is continuously monitored. Fractions are collected and further analyzed by SDS-PAGE.

Fractions containing the polypeptide are then pooled and mixed with 4 volumes of water. The diluted sample is then loaded onto a previously prepared set of tandem columns of strong anion (Poros HQ-50, Perseptive Biosystems) and weak anion (Poros CM-20, Perseptive Biosystems) exchange resins. The columns are equilibrated with 40 mM sodium acetate, pH 6.0. Both columns are washed with 40 mM sodium acetate, pH 6.0, 200 mM NaCl. The CM-20 column is then eluted using a 10 column volume linear gradient ranging from 0.2 M NaCl, 50 mM sodium acetate, pH 6.0 to 1.0 M NaCl, 50 mM sodium acetate, pH 6.5. Fractions are collected under constant $A_{280}$ monitoring of the effluent. Fractions containing the polypeptide (determined, for instance, by 16% SDS-PAGE) are then pooled.

The resultant polypeptide should exhibit greater than 95% purity after the above refolding and purification steps. No major contaminant bands should be observed from Commassie blue stained 16% SDS-PAGE gel when 5 µg of purified protein is loaded. The purified protein can also be tested for endotoxin/LPS contamination, and typically the LPS content is less than 0.1 ng/ml according to LAL assays.

Example 7

Cloning and Expression of a Polypeptide in a Baculovirus Expression System

In this example, the plasmid shuttle vector pA2 is used to insert a polynucleotide into a baculovirus to express a polypeptide. This expression vector contains the strong polyhedrin promoter of the *Autographa californica* nuclear polyhedrosis virus (AcMNPV) followed by convenient restriction sites such as BamHI, Xba I and Asp718. The polyadenylation site of the simian virus 40 ("SV40") is used for efficient polyadenylation. For easy selection of recombinant virus, the plasmid contains the beta-galactosidase gene from *E. coli* under control of a weak *Drosophila* promoter in the same orientation, followed by the polyadenylation signal of the polyhedrin gene. The inserted genes are flanked on both sides by viral sequences for cell-mediated homologous recombination with wild-type viral DNA to generate a viable virus that express the cloned polynucleotide.

Many other baculovirus vectors can be used in place of the vector above, such as pAc373, pVL941, and pAcIM1, as one skilled in the art would readily appreciate, as long as the construct provides appropriately located signals for transcription, translation, secretion and the like, including a signal peptide and an in-frame AUG as required. Such vectors are described, for instance, in Luckow et al., Virology 170:31-39 (1989).

Specifically, the cDNA sequence contained in the deposited clone, including the AUG initiation codon, is amplified using the PCR protocol described in Example 1. If a naturally occurring signal sequence is used to produce the polypeptide of the present invention, the pA2 vector does not need a second signal peptide. Alternatively, the vector can be modified (pA2 GP) to include a baculovirus leader sequence, using the standard methods described in Summers et al., "A Manual of Methods for Baculovirus Vectors and Insect Cell Culture Procedures," Texas Agricultural Experimental Station Bulletin No. 1555 (1987).

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The plasmid is digested with the corresponding restriction enzymes and optionally, can be dephosphorylated using calf intestinal phosphatase, using routine procedures known in the art. The DNA is then isolated from a 1% agarose gel using a commercially available kit ("Geneclean" BIO 101 Inc., La Jolla, Calif.).

The fragment and the dephosphorylated plasmid are ligated together with T4 DNA ligase. *E. coli* HB101 or other suitable *E. coli* hosts such as XL-1 Blue (Stratagene Cloning Systems, La Jolla, Calif.) cells are transformed with the ligation mixture and spread on culture plates. Bacteria containing the plasmid are identified by digesting DNA from individual colonies and analyzing the digestion product by gel electrophoresis. The sequence of the cloned fragment is confirmed by DNA sequencing.

Five μg of a plasmid containing the polynucleotide is co-transfected with 1.0 μg of a commercially available linearized baculovirus DNA ("BACULOGOLD™ baculovirus DNA, Pharmingen, San Diego, Calif.), using the lipofection method described by Felgner et al., Proc. Natl. Acad. Sci. USA 84:7413-7417 (1987). One μg of BACULOGOLD™ virus DNA and 5 μg of the plasmid are mixed in a sterile well of a microtiter plate containing 50 μl of serum-free Grace's medium (Life Technologies Inc., Gaithersburg, Md.). Afterwards, 10 μl LIPOFECTIN™ plus 90 μl Grace's medium are added, mixed and incubated for 15 minutes at room temperature. Then the transfection mixture is added drop-wise to Sf9 insect cells (ATCC™ CRL 1711) seeded in a 35 mm tissue culture plate with 1 ml Grace's medium without serum. The plate is then incubated for 5 hours at 27° C. The transfection solution is then removed from the plate and 1 ml of Grace's insect medium supplemented with 10% fetal calf serum is added. Cultivation is then continued at 27° C. for four days.

After four days the supernatant is collected and a plaque assay is performed, as described by Summers and Smith, supra. An agarose gel with "Blue Gal" (Life Technologies Inc., Gaithersburg) is used to allow easy identification and isolation of gal-expressing clones, which produce blue-stained plaques. (A detailed description of a "plaque assay" of this type can also be found in the user's guide for insect cell culture and baculovirology distributed by Life Technologies Inc., Gaithersburg, page 9-10.) After appropriate incubation, blue stained plaques are picked with the tip of a micropipettor (e.g., Eppendorf). The agar containing the recombinant viruses is then resuspended in a microcentrifuge tube containing 200 μl of Grace's medium and the suspension containing the recombinant baculovirus is used to infect Sf9 cells seeded in 35 mm dishes. Four days later the supernatants of these culture dishes are harvested and then they are stored at 4° C.

To verify the expression of the polypeptide, Sf9 cells are grown in Grace's medium supplemented with 10% heat-inactivated FBS. The cells are infected with the recombinant baculovirus containing the polynucleotide at a multiplicity of infection ("MOI") of about 2. If radiolabeled proteins are desired, 6 hours later the medium is removed and is replaced with SF900 II medium minus methionine and cysteine (available from Life Technologies Inc., Rockville, Md.). After 42 hours, 5 μCi of $^{35}$S-methionine and 5 μCi $^{35}$S-cysteine (available from Amersham) are added. The cells are further incubated for 16 hours and then are harvested by centrifugation. The proteins in the supernatant as well as the intracellular proteins are analyzed by SDS-PAGE followed by autoradiography (if radiolabeled).

Microsequencing of the amino acid sequence of the amino terminus of purified protein may be used to determine the amino terminal sequence of the produced protein.

Example 8

Expression of a Polypeptide in Mammalian Cells

The polypeptide of the present invention can be expressed in a mammalian cell. A typical mammalian expression vector contains a promoter element, which mediates the initiation of transcription of mRNA, a protein coding sequence, and signals required for the termination of transcription and polyadenylation of the transcript. Additional elements include enhancers, Kozak sequences and intervening sequences flanked by donor and acceptor sites for RNA splicing. Highly efficient transcription is achieved with the early and late promoters from SV40, the long terminal repeats (LTRs) from Retroviruses, e.g., RSV, HTLVI, HIVI and the early promoter of the cytomegalovirus (CMV). However, cellular elements can also be used (e.g., the human actin promoter).

Suitable expression vectors for use in practicing the present invention include, for example, vectors such as pSVL and pMSG (Pharmacia, Uppsala, Sweden), pRSVcat (ATCC™ 37152), pSV2dhfr (ATCC™ 37146), pBC12MI (ATCC™ 67109), pCMVSport 2.0, and pCMVSport 3.0. Mammalian host cells that could be used include, human Hela, 293, H9 and Jurkat cells, mouse NIH3T3 and C127 cells, Cos 1, Cos 7 and CVI, quail QC1-3 cells, mouse L cells and Chinese hamster ovary (CHO) cells.

Alternatively, the polypeptide can be expressed in stable cell lines containing the polynucleotide integrated into a chromosome. The co-transfection with a selectable marker such as DHFR, gpt, neomycin, or hygromycin allows the identification and isolation of the transfected cells.

The transfected gene can also be amplified to express large amounts of the encoded protein. The DHFR (dihydrofolate reductase) marker is useful in developing cell lines that carry several hundred or even several thousand copies of the gene of interest. (See, e.g., Alt, F. W., et al., J. Biol. Chem. 253:1357-1370 (1978); Hamlin, J. L. and Ma, C., Biochem. et Biophys. Acta, 1097:107-143 (1990); Page, M. J. and Sydenham, M. A., Biotechnology 9:64-68 (1991)). Another useful selection marker is the enzyme glutamine synthase (GS) (Murphy et al., Biochem J. 227:277-279 (1991); Bebbington et al., Bio/Technology 10:169-175 (1992). Using these markers, the mammalian cells are grown in selective medium and the cells with the highest resistance are selected. These cell lines contain the amplified gene(s) integrated into a chromosome. Chinese hamster ovary (CHO) and NSO cells are often used for the production of proteins.

Derivatives of the plasmid pSV2-dhfr (ATCC™ Accession No. 37146), the expression vectors pC4 (ATCC™ Accession No. 209646) and pC6 (ATCC™ Accession No. 209647) contain the strong promoter (LTR) of the Rous Sarcoma Virus (Cullen et al., Molecular and Cellular Biology, 438-447 (March, 1985)) plus a fragment of the CMV-enhancer (Boshart et al., Cell 41:521-530 (1985)). Multiple cloning sites, e.g., with the restriction enzyme cleavage sites BamHI, XbaI and Asp718, facilitate the cloning of the gene of interest. The vectors also contain the 3' intron, the polyadenylation and termination signal of the rat preproinsulin gene, and the mouse DHFR gene under control of the SV40 early promoter.

Specifically, the plasmid pC6, for example, is digested with appropriate restriction enzymes and then dephosphorylated using calf intestinal phosphates by procedures known in the art. The vector is then isolated from a 1% agarose gel.

A polynucleotide of the present invention is amplified according to the protocol outlined in Example 1. If a naturally occurring signal sequence is used to produce the polypeptide of the present invention, the vector does not need a second signal peptide. Alternatively, if a naturally occurring signal sequence is not used, the vector can be modified to include a heterologous signal sequence. (See, e.g., International Publication No. WO 96/34891.)

The amplified fragment is isolated from a 1% agarose gel using a commercially available kit ("GENECLEAN™," BIO 101 Inc., La Jolla, Calif.). The fragment then is digested with appropriate restriction enzymes and again purified on a 1% agarose gel.

The amplified fragment is then digested with the same restriction enzyme and purified on a 1% agarose gel. The isolated fragment and the dephosphorylated vector are then ligated with T4 DNA ligase. E. coli HB101 or XL-1 Blue cells are then transformed and bacteria are identified that contain the fragment inserted into plasmid pC6 using, for instance, restriction enzyme analysis.

Chinese hamster ovary cells lacking an active DHFR gene is used for transfection. Five μg of the expression plasmid pC6 or pC4 is cotransfected with 0.5 μg of the plasmid pSV-neo using LIPOFECTIN™ (Felgner et al., supra). The plasmid pSV2-neo contains a dominant selectable marker, the neo gene from Tn5 encoding an enzyme that confers resistance to a group of antibiotics including G418. The cells are seeded in alpha minus MEM supplemented with 1 mg/ml G418. After 2 days, the cells are trypsinized and seeded in hybridoma cloning plates (Greiner, Germany) in alpha minus MEM supplemented with 10, 25, or 50 ng/ml of methotrexate plus 1 mg/ml G418. After about 10-14 days single clones are trypsinized and then seeded in 6-well petri dishes or 10 ml flasks using different concentrations of methotrexate (50 nM, 100 nM, 200 nM, 400 nM, 800 nM). Clones growing at the highest concentrations of methotrexate are then transferred to new 6-well plates containing even higher concentrations of methotrexate (1 μM, 2 μM, 5 μM, 10 mM, 20 mM). The same procedure is repeated until clones are obtained which grow at a concentration of 100-200 μM. Expression of the desired gene product is analyzed, for instance, by SDS-PAGE and Western blot or by reversed phase HPLC analysis.

Example 9

Protein Fusions

The polypeptides of the present invention are preferably fused to other proteins. These fusion proteins can be used for a variety of applications. For example, fusion of the present polypeptides to His-tag, HA-tag, protein A, IgG domains, and maltose binding protein facilitates purification. (See Example 5; see also EPA 394,827; Traunecker, et al., Nature 331:84-86 (1988)). Similarly, fusion to IgG-1, IgG-3, and albumin increases the halflife time in vivo. Nuclear localization signals fused to the polypeptides of the present invention can target the protein to a specific subcellular localization, while covalent heterodimer or homodimers can increase or decrease the activity of a fusion protein. Fusion proteins can also create chimeric molecules having more than one function. Finally, fusion proteins can increase solubility and/or stability of the fused protein compared to the non-fused protein. All of the types of fusion proteins described above can be made by modifying the following protocol, which outlines the fusion of a polypeptide to an IgG molecule, or the protocol described in Example 5.

Briefly, the human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector.

For example, if pC4 (ATCC™ Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide of the present invention, isolated by the PCR protocol described in Example 1, is ligated into this BamHI site. Note that the polynucleotide is cloned without a stop codon, otherwise a fusion protein will not be produced.

If the naturally occurring signal sequence is used to produce the polypeptide of the present invention, pC4 does not need a second signal peptide. Alternatively, if the naturally occurring signal sequence is not used, the vector can be modified to include a heterologous signal sequence. (See, e.g., International Publication No. WO 96/34891.)

Human IgG Fc region:

GGGATCCGGAGCCCAAATCTTCTGA-CAAAACTCACACATGCCCACCGTGCCCA

GCACCTGAATTCGAGGGTGCACCGT-CAGTCTTCCTCTTCCCCCCAAAACCCAAG

GACACCCTCATGATCTCCCGGACTCCT-GAGGTCACATGCGTGGTGGTGGACGTA

AGCCACGAAGACCCTGAGGTCAAGT-TCAACTGGTACGTGGACGGCGTGGAGGT

GCATAATGCCAAGACAAAGCCGCGGGAG-GAGCAGTACAACAGCACGTACCGTG

TGGTCAGCGTCCTCACCGTCCTGCAC-CAGGACTGGCTGAATGGCAAGGAGTAC

AAGTGCAAGGTCTCCAACAAAGCCCTC-CCAACCCCCATCGAGAAAACCATCTC

CAAAGCCAAAGGGCAGCCCCGAGAACCA-CAGGTGTACACCCTGCCCCCATCCC

GGGATGAGCTGACCAAGAACCAGGT-CAGCCTGACCTGCCTGGTCAAAGGCTTC

TATCCAAGCGACATCGCCGTGGAGTGG-GAGAGCAATGGGCAGCCGGAGAACAA

CTACAAGACCACGCCTCCCGTGCTG-GACTCCGACGGCTCCTTCTTCCTCTACAG

CAAGCTCACCGTGGACAAGAGCAGGTG-GCAGCAGGGGAACGTCTTCTCATGCT

CCGTGATGCATGAGGCTCTGCACAAC-CACTACACGCAGAAGAGCCTCTCCCTGT

CTCCGGGTAAATGAGTGCGACGGCCGC-GACTCTAGAGGAT (SEQ ID NO: 1)

Example 10

Production of an Antibody from a Polypeptide a) Hybridoma Technology

The antibodies of the present invention can be prepared by a variety of methods. (See, Current Protocols, Chapter 2.) As one example of such methods, cells expressing a polypeptide of the present invention are administered to an animal to induce the production of sera containing polyclonal antibodies. In a preferred method, a preparation of a polypeptide of the present invention is prepared and purified to render it substantially free of natural contaminants. Such a preparation is then introduced into an animal in order to produce polyclonal antisera of greater specific activity.

Monoclonal antibodies specific for a polypeptide of the present invention are prepared using hybridoma technology (Kohler et al., Nature 256:495 (1975); Kohler et al., Eur. J. Immunol. 6:511 (1976); Kohler et al., Eur. J. Immunol. 6:292 (1976); Hammerling et al., in: Monoclonal Antibodies and T-Cell Hybridomas, Elsevier, N.Y., pp. 563-681 (1981)). In general, an animal (preferably a mouse) is immunized with a polypeptide of the present invention or, more preferably, with a secreted polypeptide-expressing cell. Such polypeptide-expressing cells are cultured in any suitable tissue culture medium, preferably in Earle's modified Eagle's medium supplemented with 10% fetal bovine serum (inactivated at about 56° C.), and supplemented with about 10 g/l of nonessential amino acids, about 1,000 U/ml of penicillin, and about 100 μg/ml of streptomycin.

The splenocytes of such mice are extracted and fused with a suitable myeloma cell line. Any suitable myeloma cell line may be employed in accordance with the present invention; however, it is preferable to employ the parent myeloma cell line (SP2O), available from the ATCC™. After fusion, the resulting hybridoma cells are selectively maintained in HAT medium, and then cloned by limiting dilution as described by Wands et al. (Gastroenterology 80:225-232 (1981)). The hybridoma cells obtained through such a selection are then assayed to identify clones which secrete antibodies capable of binding the polypeptide of the present invention.

Alternatively, additional antibodies capable of binding to a polypeptide of the present invention can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the polypeptide-specific antibody can be blocked by said polypeptide. Such antibodies comprise anti-idiotypic antibodies to the polypeptide-specific antibody and are used to immunize an animal to induce formation of further polypeptide-specific antibodies.

For in vivo use of antibodies in humans, an antibody is "humanized". Such antibodies can be produced using genetic constructs derived from hybridoma cells producing the monoclonal antibodies described above. Methods for producing chimeric and humanized antibodies are known in the art and are discussed herein. (See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., International Publication No. WO 8702671; Boulianne et al., Nature 312:643 (1984); Neuberger et al., Nature 314:268 (1985)).

b) Isolation of Antibody Fragments Directed Against a Polypeptide of the Present Invention from a Library of scFvs Naturally occurring V-genes isolated from human PBLs are constructed into a library of antibody fragments which contain reactivities against a polypeptide of the present invention to which the donor may or may not have been exposed (see e.g., U.S. Pat. No. 5,885,793 incorporated herein by reference in its entirety).

Rescue of the Library. A library of scFvs is constructed from the RNA of human PBLs as described in International Publication No. WO 92/01047. To rescue phage displaying antibody fragments, approximately $10^9$ E. coli harboring the phagemid are used to inoculate 50 ml of 2×TY containing 1% glucose and 100 μg/ml of ampicillin (2×TY-AMP-GLU) and grown to an O.D. of 0.8 with shaking. Five ml of this culture is used to inoculate 50 ml of 2×TY-AMP-GLU, 2×108 TU of delta gene 3 helper (M13 delta gene III, see International Publication No. WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100 μg/ml ampicillin and 50 ug/ml kanamycin and grown overnight. Phage are prepared as described in International Publication No. WO 92/01047.

M13 delta gene III is prepared as follows: M13 delta gene III helper phage does not encode gene III protein, hence the phage(mid) displaying antibody fragments have a greater avidity of binding to antigen. Infectious M13 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8,400 r.p.m. for 10 min), resuspended in 300 ml 2×TY broth containing 100 μg ampicillin/ml and 25 μg kanamycin/ml (2×TY-AMP-KAN) and grown overnight, shaking at 37° C. Phage particles are purified and concentrated from the culture medium by two PEG-precipitations (Sambrook et al., 1990), resuspended in 2 ml PBS and passed through a 0.45 μm filter (Minisart NML; Sartorius) to give a final concentration of approximately $10^{13}$ transducing units/ml (ampicillin-resistant clones).

Panning of the Library. Immunotubes (Nunc) are coated overnight in PBS with 4 ml of either 100 μg/ml or 10 μg/ml of a polypeptide of the present invention. Tubes are blocked with 2% Marvel-PBS for 2 hours at 37° C. and then washed 3 times in PBS. Approximately $10^{13}$ TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phage are then used to infect 10 ml of mid-log E. coli TG1 by incubating eluted phage with bacteria for 30 minutes at 37° C. The E. coli are then plated on TYE plates containing 1% glucose and 100 μg/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders. Eluted phage from the 3rd and 4th rounds of selection are used to infect E. coli HB 2151 and soluble scFv is produced (Marks, et al., 1991) from single colonies for assay. ELISAs are performed with microtitre plates coated with either 10 pg/ml of the polypeptide of the present invention in 50 mM bicarbonate pH 9.6. Clones positive in ELISA are further characterized by PCR fingerprinting (see, e.g., International Publication No. WO 92/01047) and then by sequencing. These ELISA positive clones may also be further characterized by techniques known in the art, such as, for example, epitope mapping, binding affinity, receptor signal transduction, ability to block or competitively inhibit antibody/antigen binding, and competitive agonistic or antagonistic activity.

Example 11

Method of Determining Alterations in a Gene Corresponding to a Polynucleotide

RNA isolated from entire families or individual patients presenting with a phenotype of interest (such as a disease) is isolated. cDNA is then generated from these RNA samples using protocols known in the art. (See, Sambrook.) The cDNA is then used as a template for PCR, employing primers surrounding regions of interest in SEQ ID NO:X; and/or the nucleotide sequence of the cDNA contained in ATCC™ Deposit No:Z. Suggested PCR conditions consist of 35 cycles at 95 degrees C. for 30 seconds; 60-120 seconds at 52-58 degrees C.; and 60-120 seconds at 70 degrees C., using buffer solutions described in Sidransky et al., Science 252:706 (1991).

PCR products are then sequenced using primers labeled at their 5' end with T4 polynucleotide kinase, employing SequiTherm Polymerase (Epicentre Technologies). The intron-exon boundaries of selected exons is also determined and genomic PCR products analyzed to confirm the results. PCR products harboring suspected mutations are then cloned and sequenced to validate the results of the direct sequencing.

PCR products are cloned into T-tailed vectors as described in Holton et al., Nucleic Acids Research, 19:1156 (1991) and sequenced with T7 polymerase (United States Biochemical). Affected individuals are identified by mutations not present in unaffected individuals.

Genomic rearrangements are also observed as a method of determining alterations in a gene corresponding to a polynucleotide. Genomic clones isolated according to Example 2 are nick-translated with digoxigenindeoxy-uridine 5'-triphosphate (Boehringer Manheim), and FISH performed as described in Johnson et al., Methods Cell Biol. 35:73-99 (1991). Hybridization with the labeled probe is carried out using a vast excess of human cot-1 DNA for specific hybridization to the corresponding genomic locus.

Chromosomes are counterstained with 4,6-diamino-2-phenylidole and propidium iodide, producing a combination of C- and R-bands. Aligned images for precise mapping are obtained using a triple-band filter set (Chroma Technology, Brattleboro, Vt.) in combination with a cooled charge-coupled device camera (Photometrics, Tucson, Ariz.) and variable excitation wavelength filters. (Johnson et al., Genet. Anal. Tech. Appl., 8:75 (1991)). Image collection, analysis and chromosomal fractional length measurements are performed using the ISee Graphical Program System. (Inovision Corporation, Durham, N.C.) Chromosome alterations of the genomic region hybridized by the probe are identified as insertions, deletions, and translocations. These alterations are used as a diagnostic marker for an associated disease.

Example 12

Method of Detecting Abnormal Levels of a Polypeptide in a Biological Sample

A polypeptide of the present invention can be detected in a biological sample, and if an increased or decreased level of the polypeptide is detected, this polypeptide is a marker for a particular phenotype. Methods of detection are numerous, and thus, it is understood that one skilled in the art can modify the following assay to fit their particular needs.

For example, antibody-sandwich ELISAs are used to detect polypeptides in a sample, preferably a biological sample. Wells of a microtiter plate are coated with specific antibodies, at a final concentration of 0.2 to 10 ug/ml. The antibodies are either monoclonal or polyclonal and are produced by the method described in Example 10. The wells are blocked so that non-specific binding of the polypeptide to the well is reduced.

The coated wells are then incubated for >2 hours at RT with a sample containing the polypeptide. Preferably, serial dilutions of the sample should be used to validate results. The plates are then washed three times with deionized or distilled water to remove unbound polypeptide.

Next, 50 ul of specific antibody-alkaline phosphatase conjugate, at a concentration of 25-400 ng, is added and incubated for 2 hours at room temperature. The plates are again washed three times with deionized or distilled water to remove unbound conjugate.

Add 75 ul of 4-methylumbelliferyl phosphate (MUP) or p-nitrophenyl phosphate (NPP) substrate solution to each well and incubate 1 hour at room temperature. Measure the reaction by a microtiter plate reader. Prepare a standard curve, using serial dilutions of a control sample, and plot polypeptide concentration on the X-axis (log scale) and fluorescence or absorbance of the Y-axis (linear scale). Interpolate the concentration of the polypeptide in the sample using the standard curve.

Example 13

Formulation

The invention also provides methods of treatment and/or prevention of diseases or disorders (such as, for example, any one or more of the diseases or disorders disclosed herein) by administration to a subject of an effective amount of a Therapeutic. By therapeutic is meant polynucleotides or polypeptides of the invention (including fragments and variants), agonists or antagonists thereof, and/or antibodies thereto, in combination with a pharmaceutically acceptable carrier type (e.g., a sterile carrier).

The Therapeutic will be formulated and dosed in a fashion consistent with good medical practice, taking into account the clinical condition of the individual patient (especially the side effects of treatment with the Therapeutic alone), the site of delivery, the method of administration, the scheduling of administration, and other factors known to practitioners. The "effective amount" for purposes herein is thus determined by such considerations.

As a general proposition, the total pharmaceutically effective amount of the Therapeutic administered parenterally per dose will be in the range of about 1 ug/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the Therapeutic is typically administered at a dose rate of about 1 ug/kg/hour to about 50 ug/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect.

Therapeutics can be are administered orally, rectally, parenterally, intracisternally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any. The term "parenteral" as used herein refers to modes of administration which include intravenous, intramuscular, intraperitoneal, intrasternal, subcutaneous and intraarticular injection and infusion.

Therapeutics of the invention are also suitably administered by sustained-release systems. Suitable examples of sustained-release Therapeutics are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

Therapeutics of the invention are also suitably administered by sustained-release systems. Suitable examples of sustained-release Therapeutics include suitable polymeric materials (such as, for example, semi-permeable polymer matrices in the form of shaped articles, e.g., films, or mirocapsules), suitable hydrophobic materials (for example as an emulsion in an acceptable oil) or ion exchange resins, and sparingly soluble derivatives (such as, for example, a sparingly soluble salt).

Sustained-release matrices include polylactides (U.S. Pat. No. 3,773,919, EP 58,481), copolymers of L-glutamic acid and gamma-ethyl-L-glutamate (Sidman et al., Biopolymers 22:547-556 (1983)), poly (2-hydroxyethyl methacrylate) (Langer et al., J. Biomed. Mater. Res. 15:167-277 (1981), and Langer, Chem. Tech. 12:98-105 (1982)), ethylene vinyl acetate (Langer et al., Id.) or poly-D-(−)-3-hydroxybutyric acid (EP 133,988).

In a preferred embodiment, polypeptide, polynucleotide, and antibody compositions of the invention are formulated in a biodegradable, polymeric drug delivery system, for example as described in U.S. Pat. Nos. 4,938,763; 5,278,201; 5,278,202; 5,324,519; 5,340,849; and 5,487,897 and in International Publication Numbers WO01/35929, WO00/24374, and WO00/06117 which are hereby incorporated by reference in their entirety. In specific preferred embodiments the polypeptide, polynucleotide, and antibody compositions of the invention are formulated using the ATRIGEL® Biodegradable System of Atrix Laboratories, Inc. (Fort Collins, Colo.).

Examples of biodegradable polymers which can be used in the formulation of polypeptide, polynucleotide, and antibody compositions, include but are not limited to, polylactides, polyglycolides, polycaprolactones, polyanhydrides, polyamides, polyurethanes, polyesteramides, polyorthoesters, polydioxanones, polyacetals, polyketals, polycarbonates, polyorthocarbonates, polyphosphazenes, polyhydroxybutyrates, polyhydroxyvalerates, polyalkylene oxalates, polyalkylene succinates, poly(malic acid), poly(amino acids), poly(methyl vinyl ether), poly(maleic anhydride), polyvinylpyrrolidone, polyethylene glycol, polyhydroxycellulose, chitin, chitosan, and copolymers, terpolymers, or combinations or mixtures of the above materials. The preferred polymers are those that have a lower degree of crystallization and are more hydrophobic. These polymers and copolymers are more soluble in the biocompatible solvents than the highly crystalline polymers such as polyglycolide and chitin which also have a high degree of hydrogen-bonding. Preferred materials with the desired solubility parameters are the polylactides, polycaprolactones, and copolymers of these with glycolide in which there are more amorphous regions to enhance solubility. In specific preferred embodiments, the biodegradable polymers which can be used in the formulation of polypeptide, polynucleotide, and antibody compositions are poly(lactide-co-glycolides). Polymer properties such as molecular weight, hydrophobicity, and lactide/glycolide ratio may be modified to obtain the desired polypeptide, polynucleotide, or antibody release profile (See, e.g., Ravivarapu et al., Journal of Pharmaceutical Sciences 89:732-741 (2000), which is hereby incorporated by reference in its entirety).

It is also preferred that the solvent for the biodegradable polymer be non-toxic, water miscible, and otherwise biocompatible. Examples of such solvents include, but are not limited to, N-methyl-2-pyrrolidone, 2-pyrrolidone, C2 to C6 alkanols, C1 to C15 alchohols, dils, triols, and tetraols such as ethanol, glycerine propylene glycol, butanol; C3 to C15 alkyl ketones such as acetone, diethyl ketone and methyl ethyl ketone; C3 to C15 esters such as methyl acetate, ethyl acetate, ethyl lactate; alkyl ketones such as methyl ethyl ketone, C1 to C15 amides such as dimethylformamide, dimethylacetamide and caprolactam; C3 to C20 ethers such as tetrahydrofuran, or solketal; tweens, triacetin, propylene carbonate, decylmethylsulfoxide, dimethyl sulfoxide, oleic acid, 1-dodecylazacycloheptan-2-one, Other preferred solvents are benzyl alchohol, benzyl benzoate, dipropylene glycol, tributyrin, ethyl oleate, glycerin, glycofural, isopropyl myristate, isopropyl palmitate, oleic acid, polyethylene glycol, propylene carbonate, and triethyl citrate. The most preferred solvents are N-methyl-2-pyrrolidone, 2-pyrrolidone, dimethyl sulfoxide, triacetin, and propylene carbonate because of the solvating ability and their compatibility.

Additionally, formulations comprising polypeptide, polynucleotide, and antibody compositions and a biodegradable polymer may also include release-rate modification agents and/or pore-forming agents. Examples of release-rate modification agents include, but are not limited to, fatty acids, triglycerides, other like hydrophobic compounds, organic solvents, plasticizing compounds and hydrophilic compounds. Suitable release rate modification agents include, for example, esters of mono-, di-, and tricarboxylic acids, such as 2-ethoxyethyl acetate, methyl acetate, ethyl acetate, diethyl phthalate, dimethyl phthalate, dibutyl phthalate, dimethyl adipate, dimethyl succinate, dimethyl oxalate, dimethyl citrate, triethyl citrate, acetyl tributyl citrate, acetyl triethyl citrate, glycerol triacetate, di(n-butyl) sebecate, and the like; polyhydroxy alcohols, such as propylene glycol, polyethylene glycol, glycerin, sorbitol, and the like; fatty acids; triesters of glycerol, such as triglycerides, epoxidized soybean oil, and other epoxidized vegetable oils; sterols, such as cholesterol; alcohols, such as C.sub.6-C.sub.12 alkanols, 2-ethoxyethanol. The release rate modification agent may be used singly or in combination with other such agents. Suitable combinations of release rate modification agents include, but are not limited to, glycerin/propylene glycol, sorbitol/glycerine, ethylene oxide/propylene oxide, butylene glycol/adipic acid, and the like. Preferred release rate modification agents include, but are not limited to, dimethyl citrate, triethyl citrate, ethyl heptanoate, glycerin, and hexanediol. Suitable pore-forming agents that may be used in the polymer composition include, but are not limited to, sugars such as sucrose and dextrose, salts such as sodium chloride and sodium carbonate, polymers such as hydroxylpropylcellulose, carboxymethylcellulose, polyethylene glycol, and polyvinylpyrrolidone. Solid crystals that will provide a defined pore size, such as salt or sugar, are preferred.

In specific preferred embodiments the polypeptide, polynucleotide, and antibody compositions of the invention are formulated using the BEMA™ BioErodible Mucoadhesive System, MCA™ MucoCutaneous Absorption System, SMP™ Solvent MicroParticle System, or BCP™ BioCompatible Polymer System of Atrix Laboratories, Inc. (Fort Collins, Colo.).

Sustained-release Therapeutics also include liposomally entrapped Therapeutics of the invention (see generally, Langer, *Science* 249:1527-1533 (1990); Treat et al., in *Lipo-* somes in the Therapy of Infectious Disease and Cancer, Lopez-Berestein and Fidler (eds.), Liss, New York, pp. 317-327 and 353-365 (1989)). Liposomes containing the Therapeutic are prepared by methods known per se: DE 3,218,121; Epstein et al., Proc. Natl. Acad. Sci. (USA) 82:3688-3692 (1985); Hwang et al., Proc. Natl. Acad. Sci. (USA) 77:4030-4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200-800 Angstroms) unilamellar type in which the lipid content is greater than about 30 mol. percent cholesterol, the selected proportion being adjusted for the optimal Therapeutic.

In yet an additional embodiment, the Therapeutics of the invention are delivered by way of a pump (see Langer, supra; Sefton, CRC Crit. Ref. Biomed. Eng. 14:201 (1987); Buchwald et al., Surgery 88:507 (1980); Saudek et al., N. Engl. J. Med. 321:574 (1989)).

Other controlled release systems are discussed in the review by Langer (*Science* 249:1527-1533 (1990)).

For parenteral administration, in one embodiment, the Therapeutic is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation. For example, the formulation preferably does not include oxidizing agents and other compounds that are known to be deleterious to the Therapeutic.

Generally, the formulations are prepared by contacting the Therapeutic uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The Therapeutic is typically formulated in such vehicles at a concentration of about 0.1 mg/ml to 100 mg/ml, preferably 1-10 mg/ml, at a pH of about 3 to 8. It will be understood that the use of certain of the foregoing excipients, carriers, or stabilizers will result in the formation of polypeptide salts.

Any pharmaceutical used for therapeutic administration can be sterile. Sterility is readily accomplished by filtration through sterile filtration membranes (e.g., 0.2 micron membranes). Therapeutics generally are placed into a container having a sterile access port, for example, an intravenous solution bag or vial having a stopper pierceable by a hypodermic injection needle.

Therapeutics ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous Therapeutic solution, and the resulting mixture is lyophilized. The infusion solution is prepared by reconstituting the lyophilized Therapeutic using bacteriostatic Water-for-Injection.

The invention also provides a pharmaceutical pack or kit comprising one or more containers filled with one or more of the ingredients of the Therapeutics of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the Therapeutics may be employed in conjunction with other therapeutic compounds.

The Therapeutics of the invention may be administered alone or in combination with adjuvants. Adjuvants that may be administered with the Therapeutics of the invention include, but are not limited to, alum, alum plus deoxycholate (ImmunoAg), MTP-PE (Biocine Corp.), QS21 (Genentech, Inc.), BCG (e.g., THERACYS®), MPL and nonviable prepartions of *Corynebacterium parvum*. In a specific embodiment, Therapeutics of the invention are administered in combination with alum. In another specific embodiment, Therapeutics of the invention are administered in combination with QS-21. Further adjuvants that may be administered with the Therapeutics of the invention include, but are not limited to, Monophosphoryl lipid immunomodulator, Adju-Vax 100a, QS-21, QS-18, CRL1005, Aluminum salts, MF-59, and Virosomal adjuvant technology. Vaccines that may be administered with the Therapeutics of the invention include, but are not limited to, vaccines directed toward protection against MMR (measles, mumps, rubella), polio, varicella, tetanus/diptheria, hepatitis A, hepatitis B, *haemophilus influenzae* B, whooping cough, pneumonia, influenza, Lyme's Disease, rotavirus, cholera, yellow fever, Japanese encephalitis, poliomyelitis, rabies, typhoid fever, and pertussis. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

The Therapeutics of the invention may be administered alone or in combination with other therapeutic agents. Therapeutic agents that may be administered in combination with the Therapeutics of the invention, include but not limited to, chemotherapeutic agents, antibiotics, steroidal and non-steroidal anti-inflammatories, conventional immunotherapeutic agents, and/or therapeutic treatments described below. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In one embodiment, the Therapeutics of the invention are administered in combination with an anticoagulant. Anticoagulants that may be administered with the compositions of the invention include, but are not limited to, heparin, low molecular weight heparin, warfarin sodium (e.g., COUMADIN®), dicumarol, 4-hydroxycoumarin, anisindione (e.g., MIRADON™), acenocoumarol (e.g., nicoumalone, SINTHROME™), indan-1,3-dione, phenprocoumon (e.g., MARCUMAR™), ethyl biscoumacetate (e.g., TROMEXAN™), and aspirin. In a specific embodiment, compositions of the invention are administered in combination with heparin and/or warfarin. In another specific embodiment, compositions of the invention are administered in combination with warfarin. In another specific embodiment, compositions of the invention are administered in combination with warfarin and aspirin. In another specific embodiment, compositions of the invention are administered in combination with heparin. In another specific embodiment, compositions of the invention are administered in combination with heparin and aspirin.

In another embodiment, the Therapeutics of the invention are administered in combination with thrombolytic drugs. Thrombolytic drugs that may be administered with the compositions of the invention include, but are not limited to, plasminogen, lys-plasminogen, alpha2-antiplasmin, streptokinae (e.g., KABIKINASE™), antiresplace (e.g., EMINASE™), tissue plasminogen activator (t-PA, altevase, ACTIVASE™), urokinase (e.g., ABBOKINASE™), sauruplase, (Prourokinase, single chain urokinase), and aminocaproic acid (e.g., AMICAR™). In a specific embodiment, compositions of the invention are administered in combination with tissue plasminogen activator and aspirin.

In another embodiment, the Therapeutics of the invention are administered in combination with antiplatelet drugs. Antiplatelet drugs that may be administered with the compositions of the invention include, but are not limited to, aspirin, dipyridamole (e.g., PERSANTINE™), and ticlopidine (e.g., TICLID™).

In specific embodiments, the use of anti-coagulants, thrombolytic and/or antiplatelet drugs in combination with Therapeutics of the invention is contemplated for the prevention, diagnosis, and/or treatment of thrombosis, arterial thrombosis, venous thrombosis, thromboembolism, pulmonary embolism, atherosclerosis, myocardial infarction, transient ischemic attack, unstable angina. In specific embodiments, the use of anticoagulants, thrombolytic drugs and/or antiplatelet drugs in combination with Therapeutics of the invention is contemplated for the prevention of occulsion of saphenous grafts, for reducing the risk of periprocedural thrombosis as might accompany angioplasty procedures, for reducing the risk of stroke in patients with atrial fibrillation including nonrheumatic atrial fibrillation, for reducing the risk of embolism associated with mechanical heart valves and or mitral valves disease. Other uses for the therapeutics of the invention, alone or in combination with antiplatelet, anticoagulant, and/or thrombolytic drugs, include, but are not limited to, the prevention of occlusions in extracorporeal devices (e.g., intravascular canulas, vascular access shunts in hemodialysis patients, hemodialysis machines, and cardiopulmonary bypass machines).

In certain embodiments, Therapeutics of the invention are administered in combination with antiretroviral agents, nucleoside/nucleotide reverse transcriptase inhibitors (NRTIs), non-nucleoside reverse transcriptase inhibitors (NNRTIs), and/or protease inhibitors (PIs). NRTIs that may be administered in combination with the Therapeutics of the invention, include, but are not limited to, RETROVIR™ (zidovudine/AZT), VIDEX™ (didanosine/ddI), HIVID™ (zalcitabine/ddC), ZERIT™ (stavudine/d4T), EPIVIR™ (lamivudine/3TC), and COMBIVIR™ (zidovudine/lamivudine). NNRTIs that may be administered in combination with the Therapeutics of the invention, include, but are not limited to, VIRAMUNE™ (nevirapine), RESCRIPTOR™ (delavirdine), and SUSTIVA™ (efavirenz). Protease inhibitors that may be administered in combination with the Therapeutics of the invention, include, but are not limited to, CRIXIVAN™ (indinavir), NORVIR™ (ritonavir), INVIRASE™ (saquinavir), and VIRACEPT™ (nelfinavir). In a specific embodiment, antiretroviral agents, nucleoside reverse transcriptase inhibitors, non-nucleoside reverse transcriptase inhibitors, and/or protease inhibitors may be used in any combination with Therapeutics of the invention to treat AIDS and/or to prevent or treat HIV infection.

Additional NRTIs include LODENOSINE™ (F-ddA; an acid-stable adenosine NRTI; Triangle/Abbott; COVIRACIL™ (emtricitabine/FTC; structurally related to lamivudine (3TC) but with 3- to 10-fold greater activity in vitro; Triangle/Abbott); dOTC (BCH-10652, also structurally related to lamivudine but retains activity against a substantial proportion of lamivudine-resistant isolates; Biochem Pharma); Adefovir (refused approval for anti-HIV therapy by FDA; Gilead Sciences); PREVEON® (Adefovir Dipivoxil, the active prodrug of adefovir; its active form is PMEA-pp); TENOFOVIR™ (bis-POC PMPA, a PMPA prodrug; Gilead); DAPD/DXG (active metabolite of DAPD; Triangle/Abbott); D-D4FC (related to 3TC, with activity against AZT/3TC-resistant virus); GW420867X (Glaxo Wellcome); ZIAGEN™ (abacavir/159U89; Glaxo Wellcome Inc.); CS-87 (3'azido-2',3'-dideoxyuridine; WO 99/66936); and S-acyl-2-thioethyl (SATE)-bearing prodrug forms of β-L-FD4C and β-L-FddC (WO 98/17281).

Additional NNRTIs include COACTINON™ (Emivirine/MKC-442, potent NNRTI of the HEPT class; Triangle/Abbott); CAPRAVIRINE™ (AG-1549/S-1153, a next generation NNRTI with activity against viruses containing the K103N mutation; Agouron); PNU-142721 (has 20- to 50-fold greater activity than its predecessor delavirdine and is active against K103N mutants; Pharmacia & Upjohn); DPC-961 and DPC-963 (second-generation derivatives of efavirenz, designed to be active against viruses with the K103N mutation; DuPont); GW-420867X (has 25-fold greater activity than HBY097 and is active against K103N mutants; Glaxo Wellcome); CALANOLIDE A (naturally occurring agent from the latex tree; active against viruses containing either or both the Y181C and K103N mutations); and Propolis (WO 99/49830).

Additional protease inhibitors include LOPINAVIR™ (ABT378/r; Abbott Laboratories); BMS-232632 (an azapeptide; Bristol-Myres Squibb); TIPRANAVIR™ (PNU-140690, a non-peptic dihydropyrone; Pharmacia & Upjohn); PD-178390 (a nonpeptidic dihydropyrone; Parke-Davis); BMS 232632 (an azapeptide; Bristol-Myers Squibb); L-756, 423 (an indinavir analog; Merck); DMP-450 (a cyclic urea compound; Avid & DuPont); AG-1776 (a peptidomimetic with in vitro activity against protease inhibitor-resistant viruses; Agouron); VX-175/GW-433908 (phosphate prodrug of amprenavir; Vertex & Glaxo Welcome); CGP61755 (Ciba); and AGENERASE™ (amprenavir; Glaxo Wellcome Inc.).

Additional antiretroviral agents include fusion inhibitors/gp41 binders. Fusion inhibitors/gp41 binders include T-20 (a peptide from residues 643-678 of the HIV gp41 transmembrane protein ectodomain which binds to gp41 in its resting state and prevents transformation to the fusogenic state; Trimeris) and T-1249 (a second-generation fusion inhibitor; Trimeris).

Additional antiretroviral agents include fusion inhibitors/chemokine receptor antagonists. Fusion inhibitors/chemokine receptor antagonists include CXCR4 antagonists such as AMD 3100 (a bicyclam), SDF-1 and its analogs, and ALX40-4C (a cationic peptide), T22 (an 18 amino acid peptide; Trimeris) and the T22 analogs T134 and T140; CCR5 antagonists such as RANTES (9-68), AOP-RANTES, NNY-RANTES, and TAK-779; and CCR5/CXCR4 antagonists such as NSC 651016 (a distamycin analog). Also included are CCR2B, CCR3, and CCR6 antagonists. Chemokine receptor agonists such as RANTES, SDF-1, MIP-1α, MIP-1β, etc., may also inhibit fusion.

Additional antiretroviral agents include integrase inhibitors. Integrase inhibitors include dicaffeoylquinic (DFQA) acids; L-chicoric acid (a dicaffeoyltartaric (DCTA) acid); quinalizarin (QLC) and related anthraquinones; ZINTEVIR™ (AR 177, an oligonucleotide that probably acts at cell surface rather than being a true integrase inhibitor; Arondex); and naphthols such as those disclosed in WO 98/50347.

Additional antiretroviral agents include hydroxyurea-like compounds such as BCX-34 (a purine nucleoside phosphorylase inhibitor; Biocryst); ribonucleotide reductase inhibitors such as DIDOX™ (Molecules for Health); inosine monophosphate dehydrogenase (IMPDH) inhibitors sucha as VX-497 (Vertex); and mycopholic acids such as CellCept (mycophenolate mofetil; Roche).

Additional antiretroviral agents include inhibitors of viral integrase, inhibitors of viral genome nuclear translocation such as arylene bis(methylketone) compounds; inhibitors of HIV entry such as AOP-RANTES, NNY-RANTES, RANTES-IgG fusion protein, soluble complexes of RANTES and glycosaminoglycans (GAG), and AMD-3100; nucleocapsid zinc finger inhibitors such as dithiane compounds; targets of HIV Tat and Rev; and pharmacoenhancers such as ABT-378.

Other antiretroviral therapies and adjunct therapies include cytokines and lymphokines such as MIP-1α, MIP-1β, SDF-1α, IL-2, PROLEUKIN™ (aldesleukin/L2-7001; Chiron), IL-4, IL-10, IL-12, and IL-13; interferons such as IFN-α2a; antagonists of TNFs, NFκB, GM-CSF, M-CSF, and IL-10; agents that modulate immune activation such as cyclosporin and prednisone; vaccines such as Remune™ (HIV Immunogen), APL 400-003 (Apollon), recombinant gp120 and fragments, bivalent (B/E) recombinant envelope glycoprotein, rgp120CM235, MN rgp120, SF-2 rgp120, gp120/soluble CD4 complex, Delta JR-FL protein, branched synthetic peptide derived from discontinuous gp120 C3/C4 domain, fusion-competent immunogens, and Gag, Pol, Nef, and Tat vaccines; gene-based therapies such as genetic suppressor elements (GSEs; WO 98/54366), and intrakines (genetically modified CC chemokines targetted to the ER to block surface expression of newly synthesized CCR5 (Yang et al., PNAS 94:11567-72 (1997); Chen et al., Nat. Med. 3:1110-16 (1997)); antibodies such as the anti-CXCR4 antibody 12G5, the anti-CCR5 antibodies 2D7, 5C7, PA8, PA9, PA10, PA11, PA12, and PA14, the anti-CD4 antibodies Q4120 and RPA-T4, the anti-CCR3 antibody 7B11, the anti-gp120 antibodies 17b, 48d, 447-52D, 257-D, 268-D and 50.1, anti-Tat antibodies, anti-TNF-α antibodies, and monoclonal antibody 33A; aryl hydrocarbon (AH) receptor agonists and antagonists such as TCDD, 3,3',4,4',5-pentachlorobiphenyl, 3,3',4,4'-tetrachlorobiphenyl, and x-naphthoflavone (WO 98/30213); and antioxidants such as γ-L-glutamyl-L-cysteine ethyl ester (γ-GCE; WO 99/56764).

In a further embodiment, the Therapeutics of the invention are administered in combination with an antiviral agent. Antiviral agents that may be administered with the Therapeutics of the invention include, but are not limited to, acyclovir, ribavirin, amantadine, and remantidine.

In other embodiments, Therapeutics of the invention may be administered in combination with anti-opportunistic infection agents. Anti-opportunistic agents that may be administered in combination with the Therapeutics of the invention, include, but are not limited to, TRIMETHOPRIM-SULFAMETHOXAZOLE™, DAPSONE™, PENTAMIDINE™, ATOVAQUONE™, ISONIAZID™, RIFAMPIN™, PYRAZINAMIDE™, ETHAMBUTOL™, RIFABUTIN™, CLARITHROMYCIN™, AZITHROMYCIN™, GANCICLOVIRT, FOSCARNE™, CIDOFOVIR™, FLUCONAZOLE™, ITRACONAZOLE™, KETOCONAZOLE™, ACYCLOVIR™, FAMCICOLVIR™, PYRIMETHAMINE™, LEUCOVORIN™, NEUPOGEN™ (filgrastim/G-CSF), and LEUKINE™ (sargramostim/GM-CSF). In a specific embodiment, Therapeutics of the invention are used in any combination with TRIMETHOPRIM-SULFAMETHOXAZOLE™, DAPSONE™, PENTAMIDINE™, and/or ATOVAQUONE™ to prophylactically treat or prevent an opportunistic Pneumocystis carinii pneumonia infection. In another specific embodiment, Therapeutics of the invention are used in any combination with ISONIAZID™, RIFAMPIN™, PYRAZINAMIDE™, and/or ETHAMBUTOL™ to prophylactically treat or prevent an opportunistic Mycobacterium avium complex infection. In another specific embodiment, Therapeutics of the invention are used in any combination with RIFABUTIN™, CLARITHROMYCIN™, and/or AZITHROMYCIN™ to prophylactically treat or prevent an opportunistic Mycobacterium tuberculosis infection. In another specific embodiment, Therapeutics of the invention are used in any combination with GANCICLOVIR™, FOSCARNET™, and/or CIDOFOVIR™ to prophylactically treat or prevent an opportunistic cytomegalovirus infection. In another specific embodiment, Therapeutics of the invention are used in any combination with FLUCONAZOLE™, ITRACONAZOLE™, and/or KETOCONAZOLE™ to prophylactically treat or prevent an opportunistic fungal infection. In another specific embodiment, Therapeutics of the invention are used in any combination with ACYCLOVIR™ and/or FAMCICOLVIR™ to prophylactically treat or prevent an opportunistic herpes simplex virus type I and/or type II infection. In another specific embodiment, Therapeutics of the invention are used in any combination with PYRIMETHAMINE™ and/or LEUCOVORIN™ to prophylactically treat or prevent an opportunistic Toxoplasma gondii infection. In another specific embodiment, Therapeutics of the invention are used in any combination with LEUCOVORIN™ and/or NEUPOGEN™ to prophylactically treat or prevent an opportunistic bacterial infection.

In a further embodiment, the Therapeutics of the invention are administered in combination with an antibiotic agent. Antibiotic agents that may be administered with the Therapeutics of the invention include, but are not limited to, amoxicillin, beta-lactamases, aminoglycosides, beta-lactam (glycopeptide), beta-lactamases, Clindamycin, chloramphenicol, cephalosporins, ciprofloxacin, erythromycin, fluoroquinolones, macrolides, metronidazole, penicillins, quinolones, rapamycin, rifampin, streptomycin, sulfonamide, tetracyclines, trimethoprim, trimethoprim-sulfamethoxazole, and vancomycin.

In other embodiments, the Therapeutics of the invention are administered in combination with immunestimulants. Immunostimulants that may be administered in combination with the Therapeutics of the invention include, but are not limited to, levamisole (e.g., ERGAMISOL™), isoprinosine (e.g. INOSIPLEX™), interferons (e.g. interferon alpha), and interleukins (e.g., IL-2).

In other embodiments, Therapeutics of the invention are administered in combination with immunosuppressive agents. Immunosuppressive agents that may be administered in combination with the Therapeutics of the invention include, but are not limited to, steroids, cyclosporine, cyclosporine analogs, cyclophosphamide methylprednisone, prednisone, azathioprine, FK-506, 15-deoxyspergualin, and other immunosuppressive agents that act by suppressing the function of responding T cells. Other immunosuppressive agents that may be administered in combination with the Therapeutics of the invention include, but are not limited to, prednisolone, methotrexate, thalidomide, methoxsalen, rapamycin, leflunomide, mizoribine (BREDININ™), brequinar, deoxyspergualin, and azaspirane (SKF 105685), ORTHOCLONE OKTO 3 (muromonab-CD3), SANDIMMUNE™, NEORAL™, SANGDYA™ (cyclosporine), PROGRAF® (FK506, tacrolimus), CELLCEP™ (mycophenolate motefil, of which the active metabolite is mycophenolic acid), IMURAN™ (azathioprine), glucocorticosteroids, adrenocortical steroids such as DELTASONE™ (prednisone) and HYDELTRASOL™ (prednisolone), FOLEX™ and MEXATE™ (methotrxate), OXSORALEN-ULTRA™ (methoxsalen) and RAPAMUNE™ (sirolimus). In a specific embodiment, immunosuppressants may be used to prevent rejection of organ or bone marrow transplantation.

In an additional embodiment, Therapeutics of the invention are administered alone or in combination with one or more intravenous immune globulin preparations. Intravenous immune globulin preparations that may be administered with the Therapeutics of the invention include, but not limited to, GAMMAR™, IVEEGAM™, SANDOGLOBULIN™, GAMMAGARD S/D™, ATGAM™ (antithymocyte globulin), and GAMIMUNE™. In a specific embodiment, Therapeutics of the invention are administered in combination with intravenous immune globulin preparations in transplantation therapy (e.g., bone marrow transplant).

In certain embodiments, the Therapeutics of the invention are administered alone or in combination with an anti-inflammatory agent. Anti-inflammatory agents that may be administered with the Therapeutics of the invention include, but are not limited to, corticosteroids (e.g. betamethasone, budesonide, cortisone, dexamethasone, hydrocortisone, methylprednisolone, prednisolone, prednisone, and triamcinolone), nonsteroidal anti-inflammatory drugs (e.g., diclofenac, diflunisal, etodolac, fenoprofen, floctafenine, flurbiprofen, ibuprofen, indomethacin, ketoprofen, meclofenamate, mefenamic acid, meloxicam, nabumetone, naproxen, oxaprozin, phenylbutazone, piroxicam, sulindac, tenoxicam, tiaprofenic acid, and tolmetin), as well as antihistamines, aminoarylcarboxylic acid derivatives, arylacetic acid derivatives, arylbutyric acid derivatives, arylcarboxylic acids, arylpropionic acid derivatives, pyrazoles, pyrazolones, salicylic acid derivatives, thiazinecarboxamides, e-acetamidocaproic acid, S-adenosylmethionine, 3-amino-4-hydroxybutyric acid, amixetrine, bendazac, benzydamine, bucolome, difenpiramide, ditazol, emorfazone, guaiazulene, nabumetone, nimesulide, orgotein, oxaceprol, paranyline, perisoxal, pifoxime, proquazone, proxazole, and tenidap.

In an additional embodiment, the compositions of the invention are administered alone or in combination with an anti-angiogenic agent. Anti-angiogenic agents that may be administered with the compositions of the invention include, but are not limited to, Angiostatin (Entremed, Rockville, Md.), Troponin-1 (Boston Life Sciences, Boston, Mass.), anti-Invasive Factor, retinoic acid and derivatives thereof, paclitaxel (Taxol), Suramin, Tissue Inhibitor of Metalloproteinase-1, Tissue Inhibitor of Metalloproteinase-2, VEGI, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include, but are not limited to, platelet factor 4; protamine sulphate; sulphated chitin derivatives (prepared from queen crab shells), (Murata et al., Cancer Res. 51:22-26, (1991)); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha,alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., J. Bio. Chem. 267:17321-17326, (1992)); Chymostatin (Tomkinson et al., Biochem J. 286:475-480, (1992)); Cyclodextrin Tetradecasulfate; Eponemycin; Camptothecin; Fumagillin (Ingber et al., Nature 348:555-557, (1990)); Gold Sodium Thiomalate ("GST"; Matsubara and Ziff, J. Clin. Invest. 79:1440-1446, (1987)); anticollagenase-serum; alpha2-antiplasmin (Holmes et al., J. Biol. Chem.

262(4):1659-1664, (1987)); Bisantrene (National Cancer Institute); Lobenzarit disodium (N-(2)-carboxyphenyl-4-chloroanthronilic acid disodium or "CCA"; (Takeuchi et al., Agents Actions 36:312-316, (1992)); and metalloproteinase inhibitors such as BB94.

Additional anti-angiogenic factors that may also be utilized within the context of the present invention include Thalidomide, (Celgene, Warren, N.J.); Angiostatic steroid; AGM-1470 (H. Brem and J. Folkman *J Pediatr. Surg.* 28:445-51 (1993)); an integrin alpha v beta 3 antagonist (C. Storgard et al., *J Clin. Invest.* 103:47-54 (1999)); carboxynaminolmidazole; Carboxyamidotriazole (CAI) (National Cancer Institute, Bethesda, Md.); Conbretastatin A-4 (CA4P) (OXiGENE, Boston, Mass.); Squalamine (Magainin Pharmaceuticals, Plymouth Meeting, Pa.); TNP-470, (Tap Pharmaceuticals, Deerfield, Ill.); ZD-0101 AstraZeneca (London, UK); APRA (CT2584); Benefin, Byrostatin-1 (SC339555); CGP-41251 (PKC 412); CM101; Dexrazoxane (ICRF187); DMXAA; Endostatin; Flavopridiol; Genestein; GTE; ImmTher; Iressa (ZD1839); Octreotide (Somatostatin); Panretin; Penacillamine; Photopoint; PI-88; Prinomastat (AG-3340) Purlytin; Suradista (FCE26644); Tamoxifen (Nolvadex); Tazarotene; Tetrathiomolybdate; Xeloda (Capecitabine); and 5-Fluorouracil.

Anti-angiogenic agents that may be administered in combination with the compounds of the invention may work through a variety of mechanisms including, but not limited to, inhibiting proteolysis of the extracellular matrix, blocking the function of endothelial cell-extracellular matrix adhesion molecules, by antagonizing the function of angiogenesis inducers such as growth factors, and inhibiting integrin receptors expressed on proliferating endothelial cells. Examples of anti-angiogenic inhibitors that interfere with extracellular matrix proteolysis and which may be administered in combination with the compositions of the invention include, but are not limited to, AG-3340 (Agouron, La Jolla, Calif.), BAY-12-9566 (Bayer, West Haven, Conn.), BMS-275291 (Bristol Myers Squibb, Princeton, N.J.), CGS-27032A (Novartis, East Hanover, N.J.), Marimastat (British Biotech, Oxford, UK), and Metastat (Aeterna, St-Foy, Quebec). Examples of anti-angiogenic inhibitors that act by blocking the function of endothelial cell-extracellular matrix adhesion molecules and which may be administered in combination with the compositions of the invention include, but are not limited to, EMD-121974 (Merck KcgaA Darmstadt, Germany) and Vitaxin (Ixsys, La Jolla, Calif./Medimmune, Gaithersburg, Md.). Examples of anti-angiogenic agents that act by directly antagonizing or inhibiting angiogenesis inducers and which may be administered in combination with the compositions of the invention include, but are not limited to, Angiozyme (Ribozyme, Boulder, Colo.), Anti-VEGF antibody (Genentech, S. San Francisco, Calif.), PTK-787/ZK-225846 (Novartis, Basel, Switzerland), SU-101 (Sugen, S. San Francisco, Calif.), SU-5416 (Sugen/Pharmacia Upjohn, Bridgewater, N.J.), and SU-6668 (Sugen). Other anti-angiogenic agents act to indirectly inhibit angiogenesis. Examples of indirect inhibitors of angiogenesis which may be administered in combination with the compositions of the invention include, but are not limited to, IM-862 (Cytran, Kirkland, Wash.), Interferon-alpha, IL-12 (Roche, Nutley, N.J.), and Pentosan polysulfate (Georgetown University, Washington, D.C.).

In particular embodiments, the use of compositions of the invention in combination with anti-angiogenic agents is contemplated for the treatment, prevention, and/or amelioration of an autoimmune disease, such as for example, an autoimmune disease described herein.

In a particular embodiment, the use of compositions of the invention in combination with anti-angiogenic agents is contemplated for the treatment, prevention, and/or amelioration of arthritis. In a more particular embodiment, the use of compositions of the invention in combination with anti-angiogenic agents is contemplated for the treatment, prevention, and/or amelioration of rheumatoid arthritis.

In another embodiment, the polynucleotides encoding a polypeptide of the present invention are administered in combination with an angiogenic protein, or polynucleotides encoding an angiogenic protein. Examples of angiogenic proteins that may be administered with the compositions of the invention include, but are not limited to, acidic and basic fibroblast growth factors, VEGF-1, VEGF-2, VEGF-3, epidermal growth factor alpha and beta, platelet-derived endothelial cell growth factor, platelet-derived growth factor, tumor necrosis factor alpha, hepatocyte growth factor, insulin-like growth factor, colony stimulating factor, macrophage colony stimulating factor, granulocyte/macrophage colony stimulating factor, and nitric oxide synthase.

In additional embodiments, compositions of the invention are administered in combination with a chemotherapeutic agent. Chemotherapeutic agents that may be administered with the Therapeutics of the invention include, but are not limited to alkylating agents such as nitrogen mustards (for example, Mechlorethamine, cyclophosphamide, Cyclophosphamide Ifosfamide, Melphalan (L-sarcolysin), and Chlorambucil), ethylenimines and methylmelamines (for example, Hexamethylmelamine and Thiotepa), alkyl sulfonates (for example, Busulfan), nitrosoureas (for example, Carmustine (BCNU), Lomustine (CCNU), Semustine (methyl-CCNU), and Streptozocin (streptozotocin)), triazenes (for example, Dacarbazine (DTIC; dimethyltriazenoimidazolecarboxamide)), folic acid analogs (for example, Methotrexate (amethopterin)), pyrimidine analogs (for example, Fluorouacil (5-fluorouracil; 5-FU), Floxuridine (fluorodeoxyuridine; FudR), and Cytarabine (cytosine arabinoside)), purine analogs and related inhibitors (for example, Mercaptopurine (6-mercaptopurine; 6-MP), Thioguanine (6-thioguanine; TG), and Pentostatin (2'-deoxycoformycin)), vinca alkaloids (for example, Vinblastine (VLB, vinblastine sulfate)) and Vincristine (vincristine sulfate)), epipodophyllotoxins (for example, Etoposide and Teniposide), antibiotics (for example, Dactinomycin (actinomycin D), Daunorubicin (daunomycin; rubidomycin), Doxorubicin, Bleomycin, Plicamycin (mithramycin), and Mitomycin (mitomycin C), enzymes (for example, L-Asparaginase), biological response modifiers (for example, Interferon-alpha and interferon-alpha-2b), platinum coordination compounds (for example, Cisplatin (cis-DDP) and Carboplatin), anthracenedione (Mitoxantrone), substituted ureas (for example, Hydroxyurea), methylhydrazine derivatives (for example, Procarbazine (N-methylhydrazine; MIH), adrenocorticosteroids (for example, Prednisone), progestins (for example, Hydroxyprogesterone caproate, Medroxyprogesterone, Medroxyprogesterone acetate, and Megestrol acetate), estrogens (for example, Diethylstilbestrol (DES), Diethylstilbestrol diphosphate, Estradiol, and Ethinyl estradiol), antiestrogens (for example, Tamoxifen), androgens (Testosterone proprionate, and Fluoxymesterone), antiandrogens (for example, Flutamide), gonadotropin-releasing horomone analogs (for example, Leuprolide), other hormones and hormone analogs (for example, methyltestosterone, estramustine, estramustine phosphate sodium, chlorotrianisene, and testolactone), and others (for example, dicarbazine, glutamic acid, and mitotane).

In one embodiment, the compositions of the invention are administered in combination with one or more of the following drugs: infliximab (also known as Remicade™ Centocor, Inc.), Trocade (Roche, RO-32-3555), Leflunomide (also known as Arava™ from Hoechst Marion Roussel), Kineret™ (an IL-1 Receptor antagonist also known as Anakinra from Amgen, Inc.)

In a specific embodiment, compositions of the invention are administered in combination with CHOP (cyclophosphamide, doxorubicin, vincristine, and prednisone) or combination of one or more of the components of CHOP. In one embodiment, the compositions of the invention are administered in combination with anti-CD20 antibodies, human monoclonal anti-CD20 antibodies. In another embodiment, the compositions of the invention are administered in combination with anti-CD20 antibodies and CHOP, or anti-CD20 antibodies and any combination of one or more of the components of CHOP, particularly cyclophosphamide and/or prednisone. In a specific embodiment, compositions of the invention are administered in combination with Rituximab. In a further embodiment, compositions of the invention are administered with Rituximab and CHOP, or Rituximab and any combination of one or more of the components of CHOP, particularly cyclophosphamide and/or prednisone. In a specific embodiment, compositions of the invention are administered in combination with tositumomab. In a further embodiment, compositions of the invention are administered with tositumomab and CHOP, or tositumomab and any combination of one or more of the components of CHOP, particularly cyclophosphamide and/or prednisone. The anti-CD20 antibodies may optionally be associated with radioisotopes, toxins or cytotoxic prodrugs.

In another specific embodiment, the compositions of the invention are administered in combination ZEVALIN™. In a further embodiment, compositions of the invention are administered with ZEVALIN™ and CHOP, or ZEVALIN™ and any combination of one or more of the components of CHOP, particularly cyclophosphamide and/or prednisone. ZEVALIN™ may be associated with one or more radiosotopes. Particularly preferred isotopes are $^{90}$Y and $^{111}$In.

In an additional embodiment, the Therapeutics of the invention are administered in combination with cytokines. Cytokines that may be administered with the Therapeutics of the invention include, but are not limited to, IL2, IL3, IL4, IL5, IL6, IL7, IL10, IL12, IL13, IL15, anti-CD40, CD40L, IFN-gamma and TNF-alpha. In another embodiment, Therapeutics of the invention may be administered with any interleukin, including, but not limited to, IL-1alpha, IL-1beta, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, and IL-21.

In one embodiment, the Therapeutics of the invention are administered in combination with members of the TNF family. TNF, TNF-related or TNF-like molecules that may be administered with the Therapeutics of the invention include, but are not limited to, soluble forms of TNF-alpha, lymphotoxin-alpha (LT-alpha, also known as TNF-beta), LT-beta (found in complex heterotrimer LT-alpha2-beta), OPGL, FasL, CD27L, CD30L, CD40L, 4-IBBL, DcR3, OX40L, TNF-gamma (International Publication No. WO 96/14328), AIM-I (International Publication No. WO 97/33899), endokine-alpha (International Publication No. WO 98/07880), OPG, and neutrokine-alpha (International Publication No. WO 98/18921, OX40, and nerve growth factor (NGF), and soluble forms of Fas, CD30, CD27, CD40 and 4-IBB, TR2 (International Publication No. WO 96/34095), DR3 (International Publication No. WO 97/33904), DR4 (International Publication No. WO 98/32856), TR5 (International Publication No. WO 98/30693), TRANK, TR9 (International Publication No. WO 98/56892), TR10 (International Publication No. WO 98/54202), 312C2 (International Publication No. WO 98/06842), and TR12, and soluble forms CD154, CD70, and CD153.

In an additional embodiment, the Therapeutics of the invention are administered in combination with angiogenic proteins. Angiogenic proteins that may be administered with the Therapeutics of the invention include, but are not limited to, Glioma Derived Growth Factor (GDGF), as disclosed in European Patent Number EP-399816; Platelet Derived Growth Factor-A (PDGF-A), as disclosed in European Patent Number EP-682110; Platelet Derived Growth Factor-B (PDGF-B), as disclosed in European Patent Number EP-282317; Placental Growth Factor (PlGF), as disclosed in International Publication Number WO 92/06194; Placental Growth Factor-2 (PlGF-2), as disclosed in Hauser et al., Growth Factors, 4:259-268 (1993); Vascular Endothelial Growth Factor (VEGF), as disclosed in International Publication Number WO 90/13649; Vascular Endothelial Growth Factor-A (VEGF-A), as disclosed in European Patent Number EP-506477; Vascular Endothelial Growth Factor-2 (VEGF-2), as disclosed in International Publication Number WO 96/39515; Vascular Endothelial Growth Factor B (VEGF-3); Vascular Endothelial Growth Factor B-186 (VEGF-B186), as disclosed in International Publication Number WO 96/26736; Vascular Endothelial Growth Factor-D (VEGF-D), as disclosed in International Publication Number WO 98/02543; Vascular Endothelial Growth Factor-D (VEGF-D), as disclosed in International Publication Number WO 98/07832; and Vascular Endothelial Growth Factor-E (VEGF-E), as disclosed in German Patent Number DE19639601. The above mentioned references are herein incorporated by reference in their entireties.

In an additional embodiment, the Therapeutics of the invention are administered in combination with Fibroblast Growth Factors. Fibroblast Growth Factors that may be administered with the Therapeutics of the invention include, but are not limited to, FGF-1, FGF-2, FGF-3, FGF-4, FGF-5, FGF-6, FGF-7, FGF-8, FGF-9, FGF-10, FGF-11, FGF-12, FGF-13, FGF-14, and FGF-15.

In an additional embodiment, the Therapeutics of the invention are administered in combination with hematopoietic growth factors. Hematopoietic growth factors that may be administered with the Therapeutics of the invention include, but are not limited to, granulocyte macrophage colony stimulating factor (GM-CSF) (sargramostim, LEUKINE™, PROKINE™), granulocyte colony stimulating factor (G-CSF) (filgrastim, NEUPOGEN™), macrophage colony stimulating factor (M-CSF, CSF-1) erythropoietin (epoetin alfa, EPOGEN™, PROCRIT™), stem cell factor (SCF, c-kit ligand, steel factor), megakaryocyte colony stimulating factor, PIXY321 (a GMCSF/IL-3 fusion protein), interleukins, especially any one or more of IL-1 through IL-12, interferon-gamma, or thrombopoietin.

In certain embodiments, Therapeutics of the present invention are administered in combination with adrenergic blockers, such as, for example, acebutolol, atenolol, betaxolol, bisoprolol, carteolol, labetalol, metoprolol, nadolol, oxprenolol, penbutolol, pindolol, propranolol, sotalol, and timolol.

In another embodiment, the Therapeutics of the invention are administered in combination with an antiarrhythmic drug (e.g., adenosine, amidoarone, bretylium, digitalis, digoxin, digitoxin, diliazem, disopyramide, esmolol, flecainide, lidocaine, mexiletine, moricizine, phenyloin, procainamide, N-acetyl procainamide, propafenone, propranolol, quinidine, sotalol, tocainide, and verapamil).

In another embodiment, the Therapeutics of the invention are administered in combination with diuretic agents, such as carbonic anhydrase-inhibiting agents (e.g., acetazolamide, dichlorphenamide, and methazolamide), osmotic diuretics (e.g., glycerin, isosorbide, mannitol, and urea), diuretics that inhibit $Na^+$-$K^+$-$2Cl^-$ symport (e.g., furosemide, bumetanide, azosemide, piretanide, tripamide, ethacrynic acid, muzolimine, and torsemide), thiazide and thiazide-like diuretics (e.g., bendroflumethiazide, benzthiazide, chlorothiazide, hydrochlorothiazide, hydroflumethiazide, methyclothiazide, polythiazide, trichormethiazide, chlorthalidone, indapamide, metolazone, and quinethazone), potassium sparing diuretics (e.g., amiloride and triamterene), and mineralcorticoid receptor antagonists (e.g., spironolactone, canrenone, and potassium canrenoate).

In one embodiment, the Therapeutics of the invention are administered in combination with treatments for endocrine and/or hormone imbalance disorders. Treatments for endocrine and/or hormone imbalance disorders include, but are not limited to, $^{127}$I, radioactive isotopes of iodine such as $^{131}$I and $^{123}$I; recombinant growth hormone, such as HUMATROPE™ (recombinant somatropin); growth hormone analogs such as PROTROPIN™ (somatrem); dopamine agonists such as PARLODEL™ (bromocriptine); somatostatin analogs such as SANDOSTATIN™ (octreotide); gonadotropin preparations such as PREGNYL™, A.P.L.™ and PROFASI™ (chorionic gonadotropin (CG)), PERGONAL™ (menotropins), and METRODIN™ (urofollitropin (uFSH)); synthetic human gonadotropin releasing hormone preparations such as FACTREL™ and LUTREPULSE™ (gonadorelin hydrochloride); synthetic gonadotropin agonists such as LUPRON™ (leuprolide acetate), SUPPRELIN™ (histrelin acetate), SYNAREL™ (nafarelin acetate), and ZOLADEX™ (goserelin acetate); synthetic preparations of thyrotropin-releasing hormone such as RELEFACT TRH™ and THYPINONE™ (protirelin); recombinant human TSH such as THYROGEN™; synthetic preparations of the sodium salts of the natural isomers of thyroid hormones such as L-$T_4$™, SYNTHROID™ and LEVOTHROID™ (levothyroxine sodium), L-$T_3$™, CYTOMEL™ and TRIOSTAT™ (liothyroine sodium), and THYROLAR™ (liotrix); antithyroid compounds such as 6-n-propylthiouracil (propylthiouracil), 1-methyl-2-mercaptoimidazole and TAPAZOLE™ (methimazole), NEO-MERCAZOLE™ (carbimazole); beta-adrenergic receptor antagonists such as propranolol and esmolol; $Ca^{2+}$ channel blockers; dexamethasone and iodinated radiological contrast agents such as TELEPAQUE™ (iopanoic acid) and ORAGRAFIN™ (sodium ipodate).

Additional treatments for endocrine and/or hormone imbalance disorders include, but are not limited to, estrogens or congugated estrogens such as ESTRACE™ (estradiol), ESTINYL™ (ethinyl estradiol), PREMARIN™, ESTRATAB™, ORTHO-EST™, OGEN™ and estropipate (estrone), ESTROVIS™ (quinestrol), ESTRADERM™ (estradiol), DELESTROGEN™ and VALERGEN™ (estradiol valerate), DEPO-ESTRADIOL CYPIONATE™ and ESTROJECT LA™ (estradiol cypionate); antiestrogens such as NOLVADEX™ (tamoxifen), SEROPHENE™ and CLOMID™ (clomiphene); progestins such as DURALUTIN™ (hydroxyprogesterone caproate), MPA™ and DEPO-PROVERA™ (medroxyprogesterone acetate), PROVERA™ and CYCRIN™ (MPA), MEGACE™ (megestrol acetate), NOR-LUTIN™ (norethindrone), and NORLUTATE™ and AYGESTIN™ (norethindrone acetate); progesterone implants such as NORPLANT SYSTEM™ (subdermal implants of norgestrel); antiprogestins such as RU 486™ (mifepristone); hormonal contraceptives such as ENOVID™ (norethynodrel plus mestranol), PROGESTASERT™ (intrauterine device that releases progesterone), LOESTRIN™, BREVICON™, MODICON™, GENORA™, NELONA™, NORINYL™, OVACON-35™ and OVACON-50™ (ethinyl estradiol/norethindrone), LEVLEN™, NORDETTE™, TR1-LEVLEN™ and TRIPHASIL-21™ (ethinyl estradiol/levonorgestrel) LO/OVRAL™ and OVRAL™ (ethinyl estradiol/norgestrel), DEMULEN™ (ethinyl estradiol/ethynodiol diacetate), NORINYL™, ORTHO-NOVUM™, NORETHIN™, GENORA™, and NELOVA™ (norethindrone/mestranol), DESOGEN™ and ORTHO-CEPT™ (ethinyl estradiol/desogestrel), ORTHO-CYCLEN™ and ORTHO-TRICYCLEN™ (ethinyl estradiol/norgestimate), MICRONOR™ and NOR-QD™ (norethindrone), and OVRETTE™ (norgestrel).

Additional treatments for endocrine and/or hormone imbalance disorders include, but are not limited to, testosterone esters such as methenolone acetate and testosterone undecanoate; parenteral and oral androgens such as TESTOJECT-50™ (testosterone), TESTEX™ (testosterone propionate), DELATESTRYL™ (testosterone enanthate), DEPO-TESTOSTERONE™ (testosterone cypionate), DANOCRINE™ (danazol), HALOTESTIN™ (fluoxymesterone), ORETON METHYL™, TESTRED™ and VIRILON™ (methyltestosterone), and OXANDRIN™ (oxandrolone); testosterone transdermal systems such as TESTODERM™; androgen receptor antagonist and 5-alpha-reductase inhibitors such as ANDROCUR™ (cyproterone acetate), EULEXIN™ (flutamide), and PROSCAR™ (finasteride); adrenocorticotropic hormone preparations such as CORTROSYN™ (cosyntropin); adrenocortical steroids and their synthetic analogs such as ACLOVATE™ (aldlometasone dipropionate), CYCLOCORT™ (amcinonide), BECLOVENT™ and VANCERIL™ (beclomethasone dipropionate), CELESTONE™ (betamethasone), BENISONE™ and UTICORT™ (betamethasone benzoate), DIPROSONE™ (betamethasone dipropionate), CELESTONE PHOSPHATE™ (betamethasone sodium phosphate), CELESTONE SOLUSPAN™ (betamethasone sodium phosphate and acetate), BETA-VAL™ and VALISONE™ (betamethasone valerate), TEMOVATE™ (clobetasol propionate), CLODERM™ (clocortolone pivalate), CORTEF™ and HYDROCORTONE™ (cortisol (hydrocortisone)), HYDROCORTONE ACETATE™ (cortisol (hydrocortisone) acetate), LOCOID™ (cortisol (hydrocortisone) butyrate), HYDROCORTONE PHOSPHATE™ (cortisol (hydrocortisone) sodium phosphate), A-HYDROCORT7 and SOLU CORTEF™ (cortisol (hydrocortisone) sodium succinate), WESTCOR™ (cortisol (hydrocortisone) valerate), CORTISONE ACETATE™ (cortisone acetate), DESOWEN™ and TRIDESILON™ (desonide), TOPICORT™ (desoximetasone), DECADRON™ (dexamethasone), DECADRON LA™ (dexamethasone acetate), DECADRON PHOSPHATE™ and HEXADROL PHOSPHATE™ (dexamethasone sodium phosphate), FLORONE™ and MAXIFLOR™ (diflorasone diacetate), FLORINEF ACETATE™ (fludrocortisone acetate), AEROBID™ and NASALIDE™ (flunisolide), FLUONID™ and SYNALAR™ (fluocinolone acetonide), LIDEX™ (fluocinonide), FLUOR-OP™ and FML™ (fluorometholone), CORDRAN™ (flurandrenolide), HALOG™ (halcinonide), HMS LIZUIFILM™ (medrysone), MEDROL™ (methylprednisolone), DEPO-MEDROL™ and MEDROL ACETATE™ (methylprednisone acetate), A-METHAPRED™ and SOLUMEDROL™ (methylprednisolone sodium succinate), ELOCON™ (mometasone furoate), HALDRONE™ (paramethasone acetate), DELTA-CORTEF™ (prednisolone), ECONOPRED™ (prednisolone acetate), HYDELTRASOL™ (prednisolone sodium phosphate), HYDELTRA-T.B.A™ (prednisolone tebutate), DELTASONE™ (prednisone), ARISTOCORT™ and KENACORT™ (triamcinolone), KENALOG™ (triamcinolone acetonide), ARISTOCORT™ and KENACORT DIACETATE™ (triamcinolone diacetate), and ARISTOSPAN™ (triamcinolone hexacetonide); inhibitors of biosynthesis and action of adrenocortical steroids such as CYTADREN™ (aminoglutethimide), NIZORAL™ (ketoconazole), MODRASTANE™ (trilostane), and METOPIRONE™ (metyrapone); bovine, porcine or human insulin or mixtures thereof; insulin analogs; recombinant human insulin such as HUMULIN™ and NOVOLIN™; oral hypoglycemic agents such as ORAMIDE™ and ORINASE™ (tolbutamide), DIABINESE™ (chlorpropamide), TOLAMIDE™ and TOLINASE™ (tolazamide), DYMELOR™ (acetohexamide), glibenclamide, MICRONASE™, DIBETA™ and GLYNASE™ (glyburide), GLUCOTROL™ (glipizide), and DIAMICRON™ (gliclazide), GLUCOPHAGE™ (metformin), ciglitazone, pioglitazone, and alpha-glucosidase inhibitors; bovine or porcine glucagon; somatostatins such as SANDOSTATIN™ (octreotide); and diazoxides such as PROGLYCEM™ (diazoxide).

In one embodiment, the Therapeutics of the invention are administered in combination with treatments for uterine motility disorders. Treatments for uterine motility disorders include, but are not limited to, estrogen drugs such as conjugated estrogens (e.g., PREMARIN® and ESTRATAB®), estradiols (e.g., CLIMARA® and ALORA®), estropipate, and chlorotrianisene; progestin drugs (e.g., AMEN® (medroxyprogesterone), MICRONOR® (norethidrone acetate), PROMETRIUM® progesterone, and megestrol acetate); and estrogen/progesterone combination therapies such as, for example, conjugated estrogens/medroxyprogesterone (e.g., PREMPRO™ and PREMPHASE®) and norethindrone acetate/ethinyl estsradiol (e.g., FEMHRT™).

In an additional embodiment, the Therapeutics of the invention are administered in combination with drugs effective in treating iron deficiency and hypochromic anemias, including but not limited to, ferrous sulfate (iron sulfate, FEOSOL™), ferrous fulmarate (e.g., FEOSTAT™), ferrous gluconate (e.g., FERGON™), polysaccharide-iron complex (e.g., NIFEREX™), iron dextran injection (e.g., INFED™), cupric sulfate, pyroxidine, riboflavin, Vitamin $B_{12}$, cyancobalamin injection (e.g., REDISOL™, RUBRAMIN PC™), hydroxocobalamin, folic acid (e.g., FOLVITE™), leucovorin (folinic acid, 5-CHOH4PteGlu, citrovorum factor) or WELLCOVORIN (Calcium salt of leucovorin), transferrin or ferritin.

In certain embodiments, the Therapeutics of the invention are administered in combination with agents used to treat psychiatric disorders. Psychiatric drugs that may be administered with the Therapeutics of the invention include, but are not limited to, antipsychotic agents (e.g., chlorpromazine, chlorprothixene, clozapine, fluphenazine, haloperidol, loxapine, mesoridazine, molindone, olanzapine, perphenazine, pimozide, quetiapine, risperidone, thioridazine, thiothixene, trifluoperazine, and triflupromazine), antimanic agents (e.g., carbamazepine, divalproex sodium, lithium carbonate, and lithium citrate), antidepressants (e.g., amitriptyline, amoxapine, bupropion, citalopram, clomipramine, desipramine, doxepin, fluvoxamine, fluoxetine, imipramine, isocarboxazid, maprotiline, mirtazapine, nefazodone, nortriptyline, paroxetine, phenelzine, protriptyline, sertraline, tranylcypromine, trazodone, trimipramine, and venlafaxine), antianxiety agents (e.g., alprazolam, buspirone, chlordiazepoxide, clorazepate, diazepam, halazepam, lorazepam, oxazepam, and prazepam), and stimulants (e.g., d-amphetamine, methylphenidate, and pemoline).

In other embodiments, the Therapeutics of the invention are administered in combination with agents used to treat neurological disorders. Neurological agents that may be administered with the Therapeutics of the invention include, but are not limited to, antiepileptic agents (e.g., carbamazepine, clonazepam, ethosuximide, phenobarbital, phenyloin, primidone, valproic acid, divalproex sodium, felbamate, gabapentin, lamotrigine, levetiracetam, oxcarbazepine, tiagabine, topiramate, zonisamide, diazepam, lorazepam, and clonazepam), antiparkinsonian agents (e.g., levodopa/carbidopa, selegiline, amantidine, bromocriptine, pergolide, ropinirole, pramipexole, benztropine; biperiden; ethopropazine; procyclidine; trihexyphenidyl, tolcapone), and ALS therapeutics (e.g. riluzole).

In another embodiment, Therapeutics of the invention are administered in combination with vasodilating agents and/or calcium channel blocking agents. Vasodilating agents that may be administered with the Therapeutics of the invention include, but are not limited to, Angiotensin Converting Enzyme (ACE) inhibitors (e.g., papaverine, isoxsuprine, benazepril, captopril, cilazapril, enalapril, enalaprilat, fosinopril, lisinopril, moexipril, perindopril, quinapril, ramipril, spirapril, trandolapril, and nylidrin), and nitrates (e.g., isosorbide dinitrate, isosorbide mononitrate, and nitroglycerin). Examples of calcium channel blocking agents that may be administered in combination with the Therapeutics of the invention include, but are not limited to amlodipine, bepridil, diltiazem, felodipine, flunarizine, isradipine, nicardipine, nifedipine, nimodipine, and verapamil.

In certain embodiments, the Therapeutics of the invention are administered in combination with treatments for gastrointestinal disorders. Treatments for gastrointestinal disorders that may be administered with the Therapeutic of the invention include, but are not limited to, $H_2$ histamine receptor antagonists (e.g., TAGAMET™ (cimetidine), ZANTAC™ (ranitidine), PEPCID™ (famotidine), and AXID™ (nizatidine)); inhibitors of $H^+$, $K^+$ ATPase (e.g., PREVACID™ (lansoprazole) and PRILOSEC™ (omeprazole)); Bismuth compounds (e.g., PEPTO-BISMOL™ (bismuth subsalicylate) and DE-NOL™ (bismuth subcitrate)); various antacids; sucralfate; prostaglandin analogs (e.g. CYTOTEC™ (misoprostol)); muscarinic cholinergic antagonists; laxatives (e.g., surfactant laxatives, stimulant laxatives, saline and osmotic laxatives); antidiarrheal agents (e.g., LOMOTIL™ (diphenoxylate), MOTOFEN™ (diphenoxin), and IMODIUM™ (loperamide hydrochloride)), synthetic analogs of somatostatin such as SANDOSTATIN™ (octreotide), antiemetic agents (e.g., ZOFRAN™ (ondansetron), KYTRIL™ (granisetron hydrochloride), tropisetron, dolasetron, metoclopramide, chlorpromazine, perphenazine, prochlorperazine, promethazine, thiethylperazine, triflupromazine, domperidone, haloperidol, droperidol, trimethobenzamide, dexamethasone, methylprednisolone, dronabinol, and nabilone); D2 antagonists (e.g., metoclopramide, trimethobenzamide and chlorpromazine); bile salts; chenodeoxycholic acid; ursodeoxycholic acid; and pancreatic enzyme preparations such as pancreatin and pancrelipase.

In additional embodiments, the Therapeutics of the invention are administered in combination with other therapeutic or prophylactic regimens, such as, for example, radiation therapy.

Example 14

Method of Treating Decreased Levels of the Polypeptide

The present invention relates to a method for treating an individual in need of an increased level of a polypeptide of the invention in the body comprising administering to such an individual a composition comprising a therapeutically effective amount of an agonist of the invention (including polypeptides of the invention). Moreover, it will be appreciated that conditions caused by a decrease in the standard or normal expression level of a polypeptide of the present invention in an individual can be treated by administering the agonist or antagonist of the present invention. Thus, the invention also provides a method of treatment of an individual in need of an increased level of the polypeptide comprising administering to such an individual a Therapeutic comprising an amount of the agonist or antagonist to increase the activity level of the polypeptide in such an individual.

For example, a patient with decreased levels of a polypeptide receives a daily dose 0.1-100 ug/kg of the agonist or antagonist for six consecutive days. The exact details of the dosing scheme, based on administration and formulation, are provided in Example 13.

Example 15

Method of Treating Increased Levels of the Polypeptide

The present invention also relates to a method of treating an individual in need of a decreased level of a polypeptide of the invention in the body comprising administering to such an individual a composition comprising a therapeutically effective amount of an antagonist of the invention (including polypeptides and antibodies of the invention).

In one example, antisense technology is used to inhibit production of a polypeptide of the present invention. This technology is one example of a method of decreasing levels of a polypeptide, due to a variety of etiologies, such as cancer.

For example, a patient diagnosed with abnormally increased levels of a polypeptide is administered intravenously antisense polynucleotides at 0.5, 1.0, 1.5, 2.0 and 3.0 mg/kg day for 21 days. This treatment is repeated after a 7-day rest period if the treatment was well tolerated. The antisense polynucleotides of the present invention can be formulated using techniques and formulations described herein (e.g. see Example 13), or otherwise known in the art.

Example 16

Method of Treatment Using Gene Therapy-Ex Vivo

One method of gene therapy transplants fibroblasts, which are capable of expressing a polypeptide, onto a patient. Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g., Ham's F12 media, with 10% FBS, penicillin and streptomycin) is added. The flasks are then incubated at 37 degree C. for approximately one week.

At this time, fresh media is added and subsequently changed every several days. After an additional two weeks in culture, a monolayer of fibroblasts emerge. The monolayer is trypsinized and scaled into larger flasks.

pMV-7 (Kirschmeier, P. T. et al., DNA, 7:219-25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

The cDNA encoding a polypeptide of the present invention can be amplified using PCR primers which correspond to the 5' and 3' end sequences respectively as set forth in Example 1 using primers and having appropriate restriction sites and initiation/stop codons, if necessary. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB101, which are then plated onto agar containing kanamycin for the purpose of confirming that the vector has the gene of interest properly inserted.

The amphotropic pA317 or GP+am12 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media. If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether protein is produced.

The engineered fibroblasts are then transplanted onto the host, either alone or after having been grown to confluence on cytodex 3 microcarrier beads.

Example 17

Gene Therapy Using Endogenous Genes Corresponding to Polynucleotides of the Invention Another method of gene therapy according to the present invention involves operably associating the endogenous polynucleotide sequence of the invention with a promoter via homologous recombination as described, for example, in U.S. Pat. No. 5,641,670, issued Jun. 24, 1997; International Publication NO: WO 96/29411, published Sep. 26, 1996; International Publication NO: WO 94/12650, published Aug. 4, 1994; Koller et al., Proc. Natl. Acad. Sci. USA, 86:8932-8935 (1989); and Zijlstra et al., Nature, 342:435-438 (1989). This method involves the activation of a gene which is present in the target cells, but which is not expressed in the cells, or is expressed at a lower level than desired.

Polynucleotide constructs are made which contain a promoter and targeting sequences, which are homologous to the 5' non-coding sequence of endogenous polynucleotide sequence, flanking the promoter. The targeting sequence will be sufficiently near the 5' end of the polynucleotide sequence so the promoter will be operably linked to the endogenous sequence upon homologous recombination. The promoter and the targeting sequences can be amplified using PCR. Preferably, the amplified promoter contains distinct restriction enzyme sites on the 5' and 3' ends. Preferably, the 3' end of the first targeting sequence contains the same restriction enzyme site as the 5' end of the amplified promoter and the 5' end of the second targeting sequence contains the same restriction site as the 3' end of the amplified promoter.

The amplified promoter and the amplified targeting sequences are digested with the appropriate restriction enzymes and subsequently treated with calf intestinal phosphatase. The digested promoter and digested targeting sequences are added together in the presence of T4 DNA ligase. The resulting mixture is maintained under conditions appropriate for ligation of the two fragments. The construct is size fractionated on an agarose gel, then purified by phenol extraction and ethanol precipitation.

In this Example, the polynucleotide constructs are administered as naked polynucleotides via electroporation. However, the polynucleotide constructs may also be administered with transfection-facilitating agents, such as liposomes, viral sequences, viral particles, precipitating agents, etc. Such methods of delivery are known in the art.

Once the cells are transfected, homologous recombination will take place which results in the promoter being operably linked to the endogenous polynucleotide sequence. This results in the expression of polynucleotide corresponding to the polynucleotide in the cell. Expression may be detected by immunological staining, or any other method known in the art.

Fibroblasts are obtained from a subject by skin biopsy. The resulting tissue is placed in DMEM+10% fetal calf serum. Exponentially growing or early stationary phase fibroblasts are trypsinized and rinsed from the plastic surface with nutrient medium. An aliquot of the cell suspension is removed for counting, and the remaining cells are subjected to centrifugation. The supernatant is aspirated and the pellet is resuspended in 5 ml of electroporation buffer (20 mM HEPES pH 7.3, 137 mM NaCl, 5 mM KCl, 0.7 mM $Na_2 HPO_4$, 6 mM dextrose). The cells are recentrifuged, the supernatant aspirated, and the cells resuspended in electroporation buffer containing 1 mg/ml acetylated bovine serum albumin. The final cell suspension contains approximately $3 \times 10^6$ cells/ml. Electroporation should be performed immediately following resuspension.

Plasmid DNA is prepared according to standard techniques. For example, to construct a plasmid for targeting to the locus corresponding to the polynucleotide of the invention, plasmid pUC18 (MBI Fermentas, Amherst, N.Y.) is digested with HindIII. The CMV promoter is amplified by PCR with an XbaI site on the 5' end and a BamHI site on the 3' end. Two non-coding sequences are amplified via PCR: one non-coding sequence (fragment 1) is amplified with a HindIII site at the 5' end and an Xba site at the 3'end; the other non-coding sequence (fragment 2) is amplified with a BamHI site at the 5'end and a HindIII site at the 3'end. The CMV promoter and the fragments (1 and 2) are digested with the appropriate enzymes (CMV promoter—XbaI and BamHI; fragment 1—XbaI; fragment 2—BamHI) and ligated together. The resulting ligation product is digested with HindIII, and ligated with the HindIII-digested pUC18 plasmid.

Plasmid DNA is added to a sterile cuvette with a 0.4 cm electrode gap (Bio-Rad). The final DNA concentration is generally at least 120 μg/ml. 0.5 ml of the cell suspension (containing approximately $1.5 \times 10^6$ cells) is then added to the cuvette, and the cell suspension and DNA solutions are gently mixed. Electroporation is performed with a Gene-Pulser apparatus (Bio-Rad). Capacitance and voltage are set at 960 μF and 250-300 V, respectively. As voltage increases, cell survival decreases, but the percentage of surviving cells that stably incorporate the introduced DNA into their genome increases dramatically. Given these parameters, a pulse time of approximately 14-20 mSec should be observed.

Electroporated cells are maintained at room temperature for approximately 5 min, and the contents of the cuvette are then gently removed with a sterile transfer pipette. The cells are added directly to 10 ml of prewarmed nutrient media (DMEM with 15% calf serum) in a 10 cm dish and incubated at 37 degree C. The following day, the media is aspirated and replaced with 10 ml of fresh media and incubated for a further 16-24 hours.

The engineered fibroblasts are then injected into the host, either alone or after having been grown to confluence on cytodex 3 microcarrier beads. The fibroblasts now produce the protein product. The fibroblasts can then be introduced into a patient as described above.

Example 18

Method of Treatment Using Gene Therapy—In Vivo

Another aspect of the present invention is using in vivo gene therapy methods to treat disorders, diseases and conditions. The gene therapy method relates to the introduction of naked nucleic acid (DNA, RNA, and antisense DNA or RNA) sequences into an animal to increase or decrease the expression of the polypeptide. The polynucleotide of the present invention may be operatively linked to (i.e., associated with) a promoter or any other genetic elements necessary for the expression of the polypeptide by the target tissue. Such gene therapy and delivery techniques and methods are known in the art, see, for example, WO90/11092, WO98/11779; U.S. Pat. No. 5,693,622, 5,705,151, 5,580,859; Tabata et al., Cardiovasc. Res. 35(3):470-479 (1997); Chao et al., Pharmacol. Res. 35(6):517-522 (1997); Wolff, Neuromuscul. Disord. 7(5):314-318 (1997); Schwartz et al., Gene Ther. 3(5):405-411 (1996); Tsurumi et al., Circulation 94(12):3281-3290 (1996) (incorporated herein by reference).

The polynucleotide constructs may be delivered by any method that delivers injectable materials to the cells of an animal, such as, injection into the interstitial space of tissues (heart, muscle, skin, lung, liver, intestine and the like). The polynucleotide constructs can be delivered in a pharmaceutically acceptable liquid or aqueous carrier.

The term "naked" polynucleotide, DNA or RNA, refers to sequences that are free from any delivery vehicle that acts to assist, promote, or facilitate entry into the cell, including viral sequences, viral particles, liposome formulations, LIPOFECTIN™ or precipitating agents and the like. However, the polynucleotides of the present invention may also be delivered in liposome formulations (such as those taught in Felgner P. L. et al. (1995) Ann. NY Acad. Sci. 772:126-139 and Abdallah B. et al. (1995) Biol. Cell 85(1):1-7) which can be prepared by methods well known to those skilled in the art.

The polynucleotide vector constructs used in the gene therapy method are preferably constructs that will not integrate into the host genome nor will they contain sequences that allow for replication. Any strong promoter known to those skilled in the art can be used for driving the expression of DNA. Unlike other gene therapy techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct can be delivered to the interstitial space of tissues within an animal, including muscle, skin, brain, lung, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked polynucleotide injection, an effective dosage amount of DNA or RNA will be in the range of from about 0.05 g/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration. The preferred route of administration is by the parenteral route of injection into the interstitial space of tissues. However, other parenteral routes may also be used, such as, inhalation of an aerosol formulation particularly for delivery to lungs or bronchial tissues, throat or mucous membranes of the nose. In addition, naked polynucleotide constructs can be delivered to arteries during angioplasty by the catheter used in the procedure.

The dose response effects of injected polynucleotide in muscle in vivo is determined as follows. Suitable template DNA for production of mRNA coding for polypeptide of the present invention is prepared in accordance with a standard recombinant DNA methodology. The template DNA, which may be either circular or linear, is either used as naked DNA or complexed with liposomes. The quadriceps muscles of mice are then injected with various amounts of the template DNA.

Five to six week old female and male Balb/C mice are anesthetized by intraperitoneal injection with 0.3 ml of 2.5% Avertin. A 1.5 cm incision is made on the anterior thigh, and the quadriceps muscle is directly visualized. The template DNA is injected in 0.1 ml of carrier in a 1 cc syringe through a 27 gauge needle over one minute, approximately 0.5 cm from the distal insertion site of the muscle into the knee and about 0.2 cm deep. A suture is placed over the injection site for future localization, and the skin is closed with stainless steel clips.

After an appropriate incubation time (e.g., 7 days) muscle extracts are prepared by excising the entire quadriceps. Every fifth 15 um cross-section of the individual quadriceps muscles is histochemically stained for protein expression. A time course for protein expression may be done in a similar fashion except that quadriceps from different mice are harvested at different times. Persistence of DNA in muscle following injection may be determined by Southern blot analysis after preparing total cellular DNA and HIRT supernatants from injected and control mice. The results of the above experimentation in mice can be used to extrapolate proper dosages and other treatment parameters in humans and other animals using naked DNA.

Example 19

Transgenic Animals

The polypeptides of the invention can also be expressed in transgenic animals. Animals of any species, including, but not limited to, mice, rats, rabbits, hamsters, guinea pigs, pigs, micro-pigs, goats, sheep, cows and non-human primates, e.g., baboons, monkeys, and chimpanzees may be used to generate transgenic animals. In a specific embodiment, techniques described herein or otherwise known in the art, are used to express polypeptides of the invention in humans, as part of a gene therapy protocol.

Any technique known in the art may be used to introduce the transgene (i.e., polynucleotides of the invention) into animals to produce the founder lines of transgenic animals. Such techniques include, but are not limited to, pronuclear microinjection (Paterson et al., Appl. Microbiol. Biotechnol. 40:691-698 (1994); Carver et al., Biotechnology (NY) 11:1263-1270 (1993); Wright et al., Biotechnology (NY) 9:830-834 (1991); and Hoppe et al., U.S. Pat. No. 4,873,191 (1989)); retrovirus mediated gene transfer into germ lines (Van der Putten et al., Proc. Natl. Acad. Sci., USA 82:6148-6152 (1985)), blastocysts or embryos; gene targeting in embryonic stem cells (Thompson et al., Cell 56:313-321 (1989)); electroporation of cells or embryos (Lo, 1983, Mol Cell. Biol. 3:1803-1814 (1983)); introduction of the polynucleotides of the invention using a gene gun (see, e.g., Ulmer et al., Science 259:1745 (1993); introducing nucleic acid constructs into embryonic pleuripotent stem cells and transferring the stem cells back into the blastocyst; and sperm-mediated gene transfer (Lavitrano et al., Cell 57:717-723 (1989); etc. For a review of such techniques, see Gordon, "Transgenic Animals," Intl. Rev. Cytol. 115:171-229 (1989), which is incorporated by reference herein in its entirety.

Any technique known in the art may be used to produce transgenic clones containing polynucleotides of the invention, for example, nuclear transfer into enucleated oocytes of nuclei from cultured embryonic, fetal, or adult cells induced to quiescence (Campell et al., Nature 380:64-66 (1996); Wilmut et al., Nature 385:810-813 (1997)).

The present invention provides for transgenic animals that carry the transgene in all their cells, as well as animals which carry the transgene in some, but not all their cells, i.e., mosaic animals or chimeric. The transgene may be integrated as a single transgene or as multiple copies such as in concatamers, e.g., head-to-head tandems or head-to-tail tandems. The transgene may also be selectively introduced into and activated in a particular cell type by following, for example, the teaching of Lasko et al. (Lasko et al., Proc. Natl. Acad. Sci.

USA 89:6232-6236 (1992)). The regulatory sequences required for such a cell-type specific activation will depend upon the particular cell type of interest, and will be apparent to those of skill in the art. When it is desired that the polynucleotide transgene be integrated into the chromosomal site of the endogenous gene, gene targeting is preferred. Briefly, when such a technique is to be utilized, vectors containing some nucleotide sequences homologous to the endogenous gene are designed for the purpose of integrating, via homologous recombination with chromosomal sequences, into and disrupting the function of the nucleotide sequence of the endogenous gene. The transgene may also be selectively introduced into a particular cell type, thus inactivating the endogenous gene in only that cell type, by following, for example, the teaching of Gu et al. (Gu et al., Science 265: 103-106 (1994)). The regulatory sequences required for such a cell-type specific inactivation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the transgene has taken place. The level of mRNA expression of the transgene in the tissues of the transgenic animals may also be assessed using techniques which include, but are not limited to, Northern blot analysis of tissue samples obtained from the animal, in situ hybridization analysis, and reverse transcriptase-PCR (rt-PCR). Samples of transgenic gene-expressing tissue may also be evaluated immunocytochemically or immunohistochemically using antibodies specific for the transgene product.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene on a distinct background that is appropriate for an experimental model of interest.

Transgenic animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Example 20

Knock-Out Animals

Endogenous gene expression can also be reduced by inactivating or "knocking out" the gene and/or its promoter using targeted homologous recombination. (e.g., see Smithies et al., Nature 317:230-234 (1985); Thomas & Capecchi, Cell 51:503-512 (1987); Thompson et al., Cell 5:313-321 (1989); each of which is incorporated by reference herein in its entirety). For example, a mutant, non-functional polynucleotide of the invention (or a completely unrelated DNA sequence) flanked by DNA homologous to the endogenous polynucleotide sequence (either the coding regions or regulatory regions of the gene) can be used, with or without a selectable marker and/or a negative selectable marker, to transfect cells that express polypeptides of the invention in vivo. In another embodiment, techniques known in the art are used to generate knockouts in cells that contain, but do not express the gene of interest. Insertion of the DNA construct, via targeted homologous recombination, results in inactivation of the targeted gene. Such approaches are particularly suited in research and agricultural fields where modifications to embryonic stem cells can be used to generate animal offspring with an inactive targeted gene (e.g., see Thomas & Capecchi 1987 and Thompson 1989, supra). However this approach can be routinely adapted for use in humans provided the recombinant DNA constructs are directly administered or targeted to the required site in vivo using appropriate viral vectors that will be apparent to those of skill in the art.

In further embodiments of the invention, cells that are genetically engineered to express the polypeptides of the invention, or alternatively, that are genetically engineered not to express the polypeptides of the invention (e.g., knockouts) are administered to a patient in vivo. Such cells may be obtained from the patient (i.e., animal, including human) or an MHC compatible donor and can include, but are not limited to fibroblasts, bone marrow cells, blood cells (e.g., lymphocytes), adipocytes, muscle cells, endothelial cells etc. The cells are genetically engineered in vitro using recombinant DNA techniques to introduce the coding sequence of polypeptides of the invention into the cells, or alternatively, to disrupt the coding sequence and/or endogenous regulatory sequence associated with the polypeptides of the invention, e.g., by transduction (using viral vectors, and preferably vectors that integrate the transgene into the cell genome) or transfection procedures, including, but not limited to, the use of plasmids, cosmids, YACs, naked DNA, electroporation, liposomes, etc. The coding sequence of the polypeptides of the invention can be placed under the control of a strong constitutive or inducible promoter or promoter/enhancer to achieve expression, and preferably secretion, of the polypeptides of the invention. The engineered cells which express and preferably secrete the polypeptides of the invention can be introduced into the patient systemically, e.g., in the circulation, or intraperitoneally.

Alternatively, the cells can be incorporated into a matrix and implanted in the body, e.g., genetically engineered fibroblasts can be implanted as part of a skin graft; genetically engineered endothelial cells can be implanted as part of a lymphatic or vascular graft. (See, for example, Anderson et al. U.S. Pat. No. 5,399,349; and Mulligan & Wilson, U.S. Pat. No. 5,460,959 each of which is incorporated by reference herein in its entirety).

When the cells to be administered are non-autologous or non-MHC compatible cells, they can be administered using well known techniques which prevent the development of a host immune response against the introduced cells. For example, the cells may be introduced in an encapsulated form which, while allowing for an exchange of components with the immediate extracellular environment, does not allow the introduced cells to be recognized by the host immune system.

Transgenic and "knock-out" animals of the invention have uses which include, but are not limited to, animal model systems useful in elaborating the biological function of polypeptides of the present invention, studying conditions

Example 21

Assays Detecting Stimulation or Inhibition of B Cell Proliferation and Differentiation Generation of functional humoral immune responses requires both soluble and cognate signaling between B-lineage cells and their microenvironment. Signals may impart a positive stimulus that allows a B-lineage cell to continue its programmed development, or a negative stimulus that instructs the cell to arrest its current developmental pathway. To date, numerous stimulatory and inhibitory signals have been found to influence B cell responsiveness including IL-2, IL-4, IL-5, IL-6, IL-7, IL10, IL-13, IL-14 and IL-15. Interestingly, these signals are by themselves weak effectors but can, in combination with various co-stimulatory proteins, induce activation, proliferation, differentiation, homing, tolerance and death among B cell populations.

One of the best studied classes of B-cell co-stimulatory proteins is the TNF-superfamily. Within this family CD40, CD27, and CD30 along with their respective ligands CD154, CD70, and CD153 have been found to regulate a variety of immune responses. Assays which allow for the detection and/or observation of the proliferation and differentiation of these B-cell populations and their precursors are valuable tools in determining the effects various proteins may have on these B-cell populations in terms of proliferation and differentiation. Listed below are two assays designed to allow for the detection of the differentiation, proliferation, or inhibition of B-cell populations and their precursors.

In Vitro Assay—Agonists or antagonists of the invention can be assessed for its ability to induce activation, proliferation, differentiation or inhibition and/or death in B-cell populations and their precursors. The activity of the agonists or antagonists of the invention on purified human tonsillar B cells, measured qualitatively over the dose range from 0.1 to 10,000 ng/mL, is assessed in a standard B-lymphocyte co-stimulation assay in which purified tonsillar B cells are cultured in the presence of either formalin-fixed *Staphylococcus aureus* Cowan I (SAC) or immobilized anti-human IgM antibody as the priming agent. Second signals such as IL-2 and IL-15 synergize with SAC and IgM crosslinking to elicit B cell proliferation as measured by tritiated-thymidine incorporation. Novel synergizing agents can be readily identified using this assay. The assay involves isolating human tonsillar B cells by magnetic bead (MACS) depletion of CD3-positive cells. The resulting cell population is greater than 95% B cells as assessed by expression of CD45R(B220).

Various dilutions of each sample are placed into individual wells of a 96-well plate to which are added $10^5$ B-cells suspended in culture medium (RPMI 1640 containing 10% FBS, $5\times10^{-5}$M 2ME, 100 U/ml penicillin, 10 ug/ml streptomycin, and $10^{-5}$ dilution of SAC) in a total volume of 150 ul. Proliferation or inhibition is quantitated by a 20 h pulse (1 uCi/well) with 3H-thymidine (6.7 Ci/mM) beginning 72 h post factor addition. The positive and negative controls are IL2 and medium respectively.

In vivo Assay—BALB/c mice are injected (i.p.) twice per day with buffer only, or 2 mg/Kg of agonists or antagonists of the invention, or truncated forms thereof. Mice receive this treatment for 4 consecutive days, at which time they are sacrificed and various tissues and serum collected for analyses. Comparison of H&E sections from normal spleens and spleens treated with agonists or antagonists of the invention identify the results of the activity of the agonists or antagonists on spleen cells, such as the diffusion of peri-arterial lymphatic sheaths, and/or significant increases in the nucleated cellularity of the red pulp regions, which may indicate the activation of the differentiation and proliferation of B-cell populations. Immunohistochemical studies using a B cell marker, anti-CD45R(B220), are used to determine whether any physiological changes to splenic cells, such as splenic disorganization, are due to increased B-cell representation within loosely defined B-cell zones that infiltrate established T-cell regions.

Flow cytometric analyses of the spleens from mice treated with agonist or antagonist is used to indicate whether the agonists or antagonists specifically increases the proportion of ThB+, CD45R(B220)dull B cells over that which is observed in control mice.

Likewise, a predicted consequence of increased mature B-cell representation in vivo is a relative increase in serum Ig titers. Accordingly, serum IgM and IgA levels are compared between buffer and agonists or antagonists-treated mice.

The studies described in this example tested activity of agonists or antagonists of the invention. However, one skilled in the art could easily modify the exemplified studies to test the activity of polynucleotides or polypeptides of the invention (e.g., gene therapy).

Example 22

T Cell Proliferation Assay

A CD3-induced proliferation assay is performed on PBMCs and is measured by the uptake of $^3$H-thymidine. The assay is performed as follows. Ninety-six well plates are coated with 100 μl/well of mAb to CD3 (HIT3a, Pharmingen) or isotype-matched control mAb (B33.1) overnight at 4 degrees C. (1 μg/ml in 0.05M bicarbonate buffer, pH 9.5), then washed three times with PBS. PBMC are isolated by F/H gradient centrifugation from human peripheral blood and added to quadruplicate wells ($5\times10^4$/well) of mAb coated plates in RPMI containing 10% FCS and P/S in the presence of varying concentrations of agonists or antagonists of the invention (total volume 200 ul). Relevant protein buffer and medium alone are controls. After 48 hr. culture at 37 degrees C., plates are spun for 2 min. at 1000 rpm and 100 μl of supernatant is removed and stored −20 degrees C. for measurement of IL-2 (or other cytokines) if effect on proliferation is observed. Wells are supplemented with 100 ul of medium containing 0.5 uCi of $^3$H-thymidine and cultured at 37 degrees C. for 18-24 hr. Wells are harvested and incorporation of $^3$H-thymidine used as a measure of proliferation. Anti-CD3 alone is the positive control for proliferation. IL-2 (100 U/ml) is also used as a control which enhances proliferation. Control antibody which does not induce proliferation of T cells is used as the negative control for the effects of agonists or antagonists of the invention.

The studies described in this example tested activity of agonists or antagonists of the invention. However, one skilled in the art could easily modify the exemplified studies to test the activity of polynucleotides or polypeptides of the invention (e.g., gene therapy).

Example 23

Effect of Agonists or Antagonists of the Invention on the Expression of MHC Class II, Costimulatory and Adhesion Molecules and Cell Differentiation of Monocytes and Monocyte-Derived Human Dendritic Cells Dendritic cells are generated by the expansion of proliferating precursors found in the peripheral blood: adherent PBMC or elutriated monocytic fractions are cultured for 7-10 days with GM-CSF (50 ng/ml) and IL-4 (20 ng/ml). These dendritic cells have the characteristic phenotype of immature cells (expression of CD1, CD80, CD86, CD40 and MHC class II antigens). Treatment with activating factors, such as TNF-α, causes a rapid change in surface phenotype (increased expression of MHC class I and II, costimulatory and adhesion molecules, downregulation of FCγ RII, upregulation of CD83). These changes correlate with increased antigen-presenting capacity and with functional maturation of the dendritic cells.

FACS analysis of surface antigens is performed as follows. Cells are treated 1-3 days with increasing concentrations of agonist or antagonist of the invention or LPS (positive control), washed with PBS containing 1% BSA and 0.02 mM sodium azide, and then incubated with 1:20 dilution of appropriate FITC- or PE-labeled monoclonal antibodies for 30 minutes at 4 degrees C. After an additional wash, the labeled cells are analyzed by flow cytometry on a FACScan (Becton Dickinson).

Effect on the production of cytokines. Cytokines generated by dendritic cells, in particular IL-12, are important in the initiation of T-cell dependent immune responses. IL-12 strongly influences the development of Th1 helper T-cell immune response, and induces cytotoxic T and NK cell function. An ELISA is used to measure the IL-12 release as follows. Dendritic cells ($10^6$/ml) are treated with increasing concentrations of agonists or antagonists of the invention for 24 hours. LPS (100 ng/ml) is added to the cell culture as positive control. Supernatants from the cell cultures are then collected and analyzed for IL-12 content using commercial ELISA kit (e.g., R & D Systems (Minneapolis, Minn.)). The standard protocols provided with the kits are used.

Effect on the expression of MHC Class II, costimulatory and adhesion molecules. Three major families of cell surface antigens can be identified on monocytes: adhesion molecules, molecules involved in antigen presentation, and Fc receptor. Modulation of the expression of MHC class II antigens and other costimulatory molecules, such as B7 and ICAM-1, may result in changes in the antigen presenting capacity of monocytes and ability to induce T cell activation. Increased expression of Fc receptors may correlate with improved monocyte cytotoxic activity, cytokine release and phagocytosis.

FACS analysis is used to examine the surface antigens as follows. Monocytes are treated 1-5 days with increasing concentrations of agonists or antagonists of the invention or LPS (positive control), washed with PBS containing 1% BSA and 0.02 mM sodium azide, and then incubated with 1:20 dilution of appropriate FITC- or PE-labeled monoclonal antibodies for 30 minutes at 4 degrees C. After an additional wash, the labeled cells are analyzed by flow cytometry on a FACScan (Becton Dickinson).

Monocyte activation and/or increased survival. Assays for molecules that activate (or alternatively, inactivate) monocytes and/or increase monocyte survival (or alternatively, decrease monocyte survival) are known in the art and may routinely be applied to determine whether a molecule of the invention functions as an inhibitor or activator of monocytes. Agonists or antagonists of the invention can be screened using the three assays described below. For each of these assays, Peripheral blood mononuclear cells (PBMC) are purified from single donor leukopacks (American Red Cross, Baltimore, Md.) by centrifugation through a HISTO-PAQUE™ gradient (Sigma). Monocytes are isolated from PBMC by counterflow centrifugal elutriation.

Monocyte Survival Assay. Human peripheral blood monocytes progressively lose viability when cultured in absence of serum or other stimuli. Their death results from internally regulated processes (apoptosis). Addition to the culture of activating factors, such as TNF-alpha dramatically improves cell survival and prevents DNA fragmentation. Propidium iodide (PI) staining is used to measure apoptosis as follows. Monocytes are cultured for 48 hours in polypropylene tubes in serum-free medium (positive control), in the presence of 100 ng/ml TNF-alpha (negative control), and in the presence of varying concentrations of the compound to be tested. Cells are suspended at a concentration of $2 \times 10^6$/ml in PBS containing PI at a final concentration of 5 μg/ml, and then incubated at room temperature for 5 minutes before FACScan analysis. PI uptake has been demonstrated to correlate with DNA fragmentation in this experimental paradigm.

Effect on cytokine release. An important function of monocytes/macrophages is their regulatory activity on other cellular populations of the immune system through the release of cytokines after stimulation. An ELISA to measure cytokine release is performed as follows. Human monocytes are incubated at a density of $5 \times 10^5$ cells/ml with increasing concentrations of agonists or antagonists of the invention and under the same conditions, but in the absence of agonists or antagonists. For IL-12 production, the cells are primed overnight with IFN (100 U/ml) in the presence of agonist or antagonist of the invention. LPS (10 ng/ml) is then added. Conditioned media are collected after 24 h and kept frozen until use. Measurement of TNF-alpha, IL-10, MCP-1 and IL-8 is then performed using a commercially available ELISA kit (e.g., R & D Systems (Minneapolis, Minn.)) and applying the standard protocols provided with the kit.

Oxidative burst. Purified monocytes are plated in 96-w plate at $2-1 \times 10^5$ cell/well. Increasing concentrations of agonists or antagonists of the invention are added to the wells in a total volume of 0.2 ml culture medium (RPMI1640+10% FCS, glutamine and antibiotics). After 3 days incubation, the plates are centrifuged and the medium is removed from the wells. To the macrophage monolayers, 0.2 ml per well of phenol red solution (140 mM NaCl, 10 mM potassium phosphate buffer pH 7.0, 5.5 mM dextrose, 0.56 mM phenol red and 19 U/ml of HRPO) is added, together with the stimulant (200 nM PMA). The plates are incubated at 37° C. for 2 hours and the reaction is stopped by adding 20 μl 1N NaOH per well. The absorbance is read at 610 nm. To calculate the amount of $H_2O_2$ produced by the macrophages, a standard curve of a $H_2O_2$ solution of known molarity is performed for each experiment.

The studies described in this example tested activity of agonists or antagonists of the invention. However, one skilled in the art could easily modify the exemplified studies to test the activity of polynucleotides or polypeptides of the invention (e.g., gene therapy).

Example 24

Biological Effects of Agonists or Antagonists of the Invention

Astrocyte and Neuronal Assays

Agonists or antagonists of the invention, expressed in *Escherichia coli* and purified as described above, can be tested for activity in promoting the survival, neurite outgrowth, or phenotypic differentiation of cortical neuronal cells and for inducing the proliferation of glial fibrillary acidic protein immunopositive cells, astrocytes. The selection of cortical cells for the bioassay is based on the prevalent expression of FGF-1 and FGF-2 in cortical structures and on the previously reported enhancement of cortical neuronal survival resulting from FGF-2 treatment. A thymidine incorporation assay, for example, can be used to elucidate an agonist or antagonist of the invention's activity on these cells.

Moreover, previous reports describing the biological effects of FGF-2 (basic FGF) on cortical or hippocampal neurons in vitro have demonstrated increases in both neuron survival and neurite outgrowth (Walicke et al., "Fibroblast growth factor promotes survival of dissociated hippocampal neurons and enhances neurite extension." *Proc. Natl. Acad. Sci. USA* 83:3012-3016. (1986), assay herein incorporated by reference in its entirety). However, reports from experiments done on PC-12 cells suggest that these two responses are not necessarily synonymous and may depend on not only which FGF is being tested but also on which receptor(s) are expressed on the target cells. Using the primary cortical neuronal culture paradigm, the ability of an agonist or antagonist of the invention to induce neurite outgrowth can be compared to the response achieved with FGF-2 using, for example, a thymidine incorporation assay.

Fibroblast and Endothelial Cell Assays

Human lung fibroblasts are obtained from Clonetics (San Diego, Calif.) and maintained in growth media from Clonetics. Dermal microvascular endothelial cells are obtained from Cell Applications (San Diego, Calif.). For proliferation assays, the human lung fibroblasts and dermal microvascular endothelial cells can be cultured at 5,000 cells/well in a 96-well plate for one day in growth medium. The cells are then incubated for one day in 0.1% BSA basal medium. After replacing the medium with fresh 0.1% BSA medium, the cells are incubated with the test proteins for 3 days. ALAMAR BLUE™ (Alamar Biosciences, Sacramento, Calif.) is added to each well to a final concentration of 10%. The cells are incubated for 4 hr. Cell viability is measured by reading in a CYTOFLUOR™ fluorescence reader. For the $PGE_2$ assays, the human lung fibroblasts are cultured at 5,000 cells/well in a 96-well plate for one day. After a medium change to 0.1% BSA basal medium, the cells are incubated with FGF-2 or agonists or antagonists of the invention with or without IL-1a for 24 hours. The supernatants are collected and assayed for $PGE_2$ by EIA kit (Cayman, Ann Arbor, Mich.). For the IL-6 assays, the human lung fibroblasts are cultured at 5,000 cells/well in a 96-well plate for one day. After a medium change to 0.1% BSA basal medium, the cells are incubated with FGF-2 or with or without agonists or antagonists of the invention IL-1α for 24 hours. The supernatants are collected and assayed for IL-6 by ELISA kit (Endogen, Cambridge, Mass.).

Human lung fibroblasts are cultured with FGF-2 or agonists or antagonists of the invention for 3 days in basal medium before the addition of ALAMAR BLUE™ to assess effects on growth of the fibroblasts. FGF-2 should show a stimulation at 10-2500 ng/ml which can be used to compare stimulation with agonists or antagonists of the invention.

Parkinson Models

The loss of motor function in Parkinson's disease is attributed to a deficiency of striatal dopamine resulting from the degeneration of the nigrostriatal dopaminergic projection neurons. An animal model for Parkinson's that has been extensively characterized involves the systemic administration of 1-methyl-4 phenyl 1,2,3,6-tetrahydropyridine (MPTP). In the CNS, MPTP is taken-up by astrocytes and catabolized by monoamine oxidase B to 1-methyl-4-phenyl pyridine ($MPP^+$) and released. Subsequently, $MPP^+$ is actively accumulated in dopaminergic neurons by the high-affinity reuptake transporter for dopamine. $MPP^+$ is then concentrated in mitochondria by the electrochemical gradient and selectively inhibits nicotinamide adenine disphosphate: ubiquinone oxidoreductionase (complex I), thereby interfering with electron transport and eventually generating oxygen radicals.

It has been demonstrated in tissue culture paradigms that FGF-2 (basic FGF) has trophic activity towards nigral dopaminergic neurons (Ferrari et al., Dev. Biol. 1989). Recently, Dr. Unsicker's group has demonstrated that administering FGF-2 in gel foam implants in the striatum results in the near complete protection of nigral dopaminergic neurons from the toxicity associated with MPTP exposure (Otto and Unsicker, J. Neuroscience, 1990).

Based on the data with FGF-2, agonists or antagonists of the invention can be evaluated to determine whether it has an action similar to that of FGF-2 in enhancing dopaminergic neuronal survival in vitro and it can also be tested in vivo for protection of dopaminergic neurons in the striatum from the damage associated with MPTP treatment. The potential effect of an agonist or antagonist of the invention is first examined in vitro in a dopaminergic neuronal cell culture paradigm. The cultures are prepared by dissecting the midbrain floor plate from gestation day 14 Wistar rat embryos. The tissue is dissociated with trypsin and seeded at a density of 200,000 cells/$cm^2$ on polyorthinine-laminin coated glass coverslips. The cells are maintained in Dulbecco's Modified Eagle's medium and F12 medium containing hormonal supplements (N1). The cultures are fixed with paraformaldehyde after 8 days in vitro and are processed for tyrosine hydroxylase, a specific marker for dopaminergic neurons, immunohistochemical staining. Dissociated cell cultures are prepared from embryonic rats. The culture medium is changed every third day and the factors are also added at that time.

Since the dopaminergic neurons are isolated from animals at gestation day 14, a developmental time which is past the stage when the dopaminergic precursor cells are proliferating, an increase in the number of tyrosine hydroxylase immunopositive neurons would represent an increase in the number of dopaminergic neurons surviving in vitro. Therefore, if an agonist or antagonist of the invention acts to prolong the survival of dopaminergic neurons, it would suggest that the agonist or antagonist may be involved in Parkinson's Disease.

The studies described in this example tested activity of agonists or antagonists of the invention. However, one skilled in the art could easily modify the exemplified studies to test the activity of polynucleotides or polypeptides of the invention (e.g., gene therapy).

Example 25

The Effect of Agonists or Antagonists of the Invention on the Growth of Vascular Endothelial Cells On day 1, human umbilical vein endothelial cells (HUVEC) are seeded at $2-5\times10^4$ cells/35 mm dish density in M199 medium containing 4% fetal bovine serum (FBS), 16 units/ml heparin, and 50 units/ml endothelial cell growth supplements (ECGS, Biotechnique, Inc.). On day 2, the medium is replaced with M199 containing 10% FBS, 8 units/ml heparin. An agonist or antagonist of the invention, and positive controls, such as VEGF and basic FGF (bFGF) are added, at varying concentrations. On days 4 and 6, the medium is replaced. On day 8, cell number is determined with a Coulter Counter.

An increase in the number of HUVEC cells indicates that the compound of the invention may proliferate vascular endothelial cells, while a decrease in the number of HUVEC cells indicates that the compound of the invention inhibits vascular endothelial cells.

The studies described in this example tested activity of a polypeptide of the invention. However, one skilled in the art could easily modify the exemplified studies to test the activity of polynucleotides (e.g., gene therapy), agonists, and/or antagonists of the invention.

Example 26

Rat Corneal Wound Healing Model

This animal model shows the effect of an agonist or antagonist of the invention on neovascularization. The experimental protocol includes:

a) Making a 1-1.5 mm long incision from the center of cornea into the stromal layer.

b) Inserting a spatula below the lip of the incision facing the outer corner of the eye.

c) Making a pocket (its base is 1-1.5 mm form the edge of the eye).

d) Positioning a pellet, containing 50 ng-5 ug of an agonist or antagonist of the invention, within the pocket.

e) Treatment with an agonist or antagonist of the invention can also be applied topically to the corneal wounds in a dosage range of 20 mg-500 mg (daily treatment for five days).

The studies described in this example tested activity of agonists or antagonists of the invention. However, one skilled in the art could easily modify the exemplified studies to test the activity of polynucleotides or polypeptides of the invention (e.g., gene therapy).

Example 27

Diabetic Mouse and Glucocorticoid-Impaired Wound Healing Models

Diabetic db+/db+ Mouse Model.

To demonstrate that an agonist or antagonist of the invention accelerates the healing process, the genetically diabetic mouse model of wound healing is used. The full thickness wound healing model in the db+/db+ mouse is a well characterized, clinically relevant and reproducible model of impaired wound healing. Healing of the diabetic wound is dependent on formation of granulation tissue and re-epithelialization rather than contraction (Gartner, M. H. et al., *J. Surg. Res.* 52:389 (1992); Greenhalgh, D. G. et al., *Am. J. Pathol.* 136:1235 (1990)).

The diabetic animals have many of the characteristic features observed in Type II diabetes mellitus. Homozygous (db+/db+) mice are obese in comparison to their normal heterozygous (db+/+m) littermates. Mutant diabetic (db+/db+) mice have a single autosomal recessive mutation on chromosome 4 (db+) (Coleman et al. *Proc. Natl. Acad. Sci. USA* 77:283-293 (1982)). Animals show polyphagia, polydipsia and polyuria. Mutant diabetic mice (db+/db+) have elevated blood glucose, increased or normal insulin levels, and suppressed cell-mediated immunity (Mandel et al., *J. Immunol.* 120:1375 (1978); Debray-Sachs, M. et al., *Clin. Exp. Immunol.* 51(1):1-7 (1983); Leiter et al., *Am. J. of Pathol.* 114:46-55 (1985)). Peripheral neuropathy, myocardial complications, and microvascular lesions, basement membrane thickening and glomerular filtration abnormalities have been described in these animals (Norido, F. et al., *Exp. Neurol.* 83(2):221-232 (1984); Robertson et al., *Diabetes* 29(1):60-67 (1980); Giacomelli et al., *Lab Invest.* 40(4):460-473 (1979); Coleman, D. L., *Diabetes* 31 (*Suppl*):1-6 (1982)). These homozygous diabetic mice develop hyperglycemia that is resistant to insulin analogous to human type II diabetes (Mandel et al., *J. Immunol.* 120:1375-1377 (1978)).

The characteristics observed in these animals suggests that healing in this model may be similar to the healing observed in human diabetes (Greenhalgh, et al., *Am. J. of Pathol.* 136: 1235-1246 (1990)).

Genetically diabetic female C57BL/KsJ (db+/db+) mice and their non-diabetic (db+/+m) heterozygous littermates are used in this study (Jackson Laboratories). The animals are purchased at 6 weeks of age and are 8 weeks old at the beginning of the study. Animals are individually housed and received food and water ad libitum. All manipulations are performed using aseptic techniques. The experiments are conducted according to the rules and guidelines of Human Genome Sciences, Inc. Institutional Animal Care and Use Committee and the Guidelines for the Care and Use of Laboratory Animals.

Wounding protocol is performed according to previously reported methods (Tsuboi, R. and Rifkin, D. B., *J. Exp. Med* 172:245-251 (1990)). Briefly, on the day of wounding, animals are anesthetized with an intraperitoneal injection of Avertin (0.01 mg/mL), 2,2,2-tribromoethanol and 2-methyl-2-butanol dissolved in deionized water. The dorsal region of the animal is shaved and the skin washed with 70% ethanol solution and iodine. The surgical area is dried with sterile gauze prior to wounding. An 8 mm full-thickness wound is then created using a Keyes tissue punch. Immediately following wounding, the surrounding skin is gently stretched to eliminate wound expansion. The wounds are left open for the duration of the experiment. Application of the treatment is given topically for 5 consecutive days commencing on the day of wounding. Prior to treatment, wounds are gently cleansed with sterile saline and gauze sponges.

Wounds are visually examined and photographed at a fixed distance at the day of surgery and at two day intervals thereafter. Wound closure is determined by daily measurement on days 1-5 and on day 8. Wounds are measured horizontally and vertically using a calibrated Jameson caliper. Wounds are considered healed if granulation tissue is no longer visible and the wound is covered by a continuous epithelium.

An agonist or antagonist of the invention is administered using at a range different doses, from 4 mg to 500 mg per wound per day for 8 days in vehicle. Vehicle control groups received 50 mL of vehicle solution.

Animals are euthanized on day 8 with an intraperitoneal injection of sodium pentobarbital (300 mg/kg). The wounds and surrounding skin are then harvested for histology and immunohistochemistry. Tissue specimens are placed in 10% neutral buffered formalin in tissue cassettes between biopsy sponges for further processing.

Three groups of 10 animals each (5 diabetic and 5 non-diabetic controls) are evaluated: 1) Vehicle placebo control, 2) untreated group, and 3) treated group.

Wound closure is analyzed by measuring the area in the vertical and horizontal axis and obtaining the total square area of the wound. Contraction is then estimated by establishing the differences between the initial wound area (day 0) and that of post treatment (day 8). The wound area on day 1 is 64 mm$^2$, the corresponding size of the dermal punch. Calculations are made using the following formula:

[Open area on day 8]−[Open area on day 1]/[Open area on day 1]

Specimens are fixed in 10% buffered formalin and paraffin embedded blocks are sectioned perpendicular to the wound surface (5 mm) and cut using a Reichert-Jung microtome. Routine hematoxylin-eosin (H&E) staining is performed on cross-sections of bisected wounds. Histologic examination of the wounds are used to assess whether the healing process and the morphologic appearance of the repaired skin is altered by treatment with an agonist or antagonist of the invention. This assessment included verification of the presence of cell accumulation, inflammatory cells, capillaries, fibroblasts, re-epithelialization and epidermal maturity (Greenhalgh, D. G. et al., *Am. J. Pathol.* 136:1235 (1990)). A calibrated lens micrometer is used by a blinded observer.

Tissue sections are also stained immunohistochemically with a polyclonal rabbit anti-human keratin antibody using ABC Elite detection system. Human skin is used as a positive tissue control while non-immune IgG is used as a negative control. Keratinocyte growth is determined by evaluating the extent of reepithelialization of the wound using a calibrated lens micrometer.

Proliferating cell nuclear antigen/cyclin (PCNA) in skin specimens is demonstrated by using anti-PCNA antibody (1:50) with an ABC Elite detection system. Human colon cancer served as a positive tissue control and human brain tissue is used as a negative tissue control. Each specimen included a section with omission of the primary antibody and substitution with non-immune mouse IgG. Ranking of these sections is based on the extent of proliferation on a scale of 0-8, the lower side of the scale reflecting slight proliferation to the higher side reflecting intense proliferation.

Experimental data are analyzed using an unpaired t test. A p value of <0.05 is considered significant.

Steroid Impaired Rat Model

The inhibition of wound healing by steroids has been well documented in various in vitro and in vivo systems (Wahl, Glucocorticoids and Wound healing. In: Anti-Inflammatory Steroid Action: Basic and Clinical Aspects. 280-302 (1989); Wahl et al., *J. Immunol.* 115: 476-481 (1975); Werb et al., *J. Exp. Med.* 147:1684-1694 (1978)). Glucocorticoids retard wound healing by inhibiting angiogenesis, decreasing vascular permeability (Ebert et al., *An. Intern. Med.* 37:701-705 (1952)), fibroblast proliferation, and collagen synthesis (Beck et al., *Growth Factors.* 5: 295-304 (1991); Haynes et al., *J. Clin. Invest.* 61: 703-797 (1978)) and producing a transient reduction of circulating monocytes (Haynes et al., *J. Clin. Invest.* 61: 703-797 (1978); Wahl, "Glucocorticoids and wound healing", In: Antiinflammatory Steroid Action: Basic and Clinical Aspects, Academic Press, New York, pp. 280-302 (1989)). The systemic administration of steroids to impaired wound healing is a well establish phenomenon in rats (Beck et al., *Growth Factors.* 5: 295-304 (1991); Haynes et al., *J. Clin. Invest.* 61: 703-797 (1978); Wahl, "Glucocorticoids and wound healing", In: Antiinflammatory Steroid Action: Basic and Clinical Aspects, Academic Press, New York, pp. 280-302 (1989); Pierce et al., *Proc. Natl. Acad. Sci. USA* 86: 2229-2233 (1989)).

To demonstrate that an agonist or antagonist of the invention can accelerate the healing process, the effects of multiple topical applications of the agonist or antagonist on full thickness excisional skin wounds in rats in which healing has been impaired by the systemic administration of methylprednisolone is assessed.

Young adult male Sprague Dawley rats weighing 250-300 g (Charles River Laboratories) are used in this example. The animals are purchased at 8 weeks of age and are 9 weeks old at the beginning of the study. The healing response of rats is impaired by the systemic administration of methylprednisolone (17 mg/kg/rat intramuscularly) at the time of wounding. Animals are individually housed and received food and water ad libitum. All manipulations are performed using aseptic techniques. This study is conducted according to the rules and guidelines of Human Genome Sciences, Inc. Institutional Animal Care and Use Committee and the Guidelines for the Care and Use of Laboratory Animals.

The wounding protocol is followed according to section A, above. On the day of wounding, animals are anesthetized with an intramuscular injection of ketamine (50 mg/kg) and xylazine (5 mg/kg). The dorsal region of the animal is shaved and the skin washed with 70% ethanol and iodine solutions. The surgical area is dried with sterile gauze prior to wounding. An 8 mm full-thickness wound is created using a Keyes tissue punch. The wounds are left open for the duration of the experiment. Applications of the testing materials are given topically once a day for 7 consecutive days commencing on the day of wounding and subsequent to methylprednisolone administration. Prior to treatment, wounds are gently cleansed with sterile saline and gauze sponges.

Wounds are visually examined and photographed at a fixed distance at the day of wounding and at the end of treatment. Wound closure is determined by daily measurement on days 1-5 and on day 8. Wounds are measured horizontally and vertically using a calibrated Jameson caliper. Wounds are considered healed if granulation tissue is no longer visible and the wound is covered by a continuous epithelium.

The agonist or antagonist of the invention is administered using at a range different doses, from 4 mg to 500 mg per wound per day for 8 days in vehicle. Vehicle control groups received 50 mL of vehicle solution.

Animals are euthanized on day 8 with an intraperitoneal injection of sodium pentobarbital (300 mg/kg). The wounds and surrounding skin are then harvested for histology. Tissue specimens are placed in 10% neutral buffered formalin in tissue cassettes between biopsy sponges for further processing.

Three groups of 10 animals each (5 with methylprednisolone and 5 without glucocorticoid) are evaluated: 1) Untreated group 2) Vehicle placebo control 3) treated groups.

Wound closure is analyzed by measuring the area in the vertical and horizontal axis and obtaining the total area of the wound. Closure is then estimated by establishing the differences between the initial wound area (day 0) and that of post treatment (day 8). The wound area on day 1 is 64 mm$^2$, the corresponding size of the dermal punch. Calculations are made using the following formula:

[Open area on day 8]−[Open area on day 1]/[Open area on day 1]

Specimens are fixed in 10% buffered formalin and paraffin embedded blocks are sectioned perpendicular to the wound surface (5 mm) and cut using an Olympus microtome. Routine hematoxylin-eosin (H&E) staining is performed on cross-sections of bisected wounds. Histologic examination of the wounds allows assessment of whether the healing process and the morphologic appearance of the repaired skin is improved by treatment with an agonist or antagonist of the invention. A calibrated lens micrometer is used by a blinded observer to determine the distance of the wound gap.

Experimental data are analyzed using an unpaired t test. A p value of <0.05 is considered significant.

The studies described in this example tested activity of agonists or antagonists of the invention. However, one skilled in the art could easily modify the exemplified studies to test the activity of polynucleotides or polypeptides of the invention (e.g., gene therapy).

Example 28

Lymphadema Animal Model

The purpose of this experimental approach is to create an appropriate and consistent lymphedema model for testing the therapeutic effects of an agonist or antagonist of the invention in lymphangiogenesis and re-establishment of the lymphatic circulatory system in the rat hind limb. Effectiveness is measured by swelling volume of the affected limb, quantification of the amount of lymphatic vasculature, total blood plasma protein, and histopathology. Acute lymphedema is observed for 7-10 days. Perhaps more importantly, the chronic progress of the edema is followed for up to 3-4 weeks.

Prior to beginning surgery, blood sample is drawn for protein concentration analysis. Male rats weighing approximately ~350 g are dosed with Pentobarbital. Subsequently, the right legs are shaved from knee to hip. The shaved area is swabbed with gauze soaked in 70% EtOH. Blood is drawn for serum total protein testing. Circumference and volumetric measurements are made prior to injecting dye into paws after marking 2 measurement levels (0.5 cm above heel, at mid-pt of dorsal paw). The intradermal dorsum of both right and left paws are injected with 0.05 ml of 1% Evan's Blue. Circumference and volumetric measurements are then made following injection of dye into paws.

Using the knee joint as a landmark, a mid-leg inguinal incision is made circumferentially allowing the femoral vessels to be located. Forceps and hemostats are used to dissect and separate the skin flaps. After locating the femoral vessels, the lymphatic vessel that runs along side and underneath the vessel(s) is located. The main lymphatic vessels in this area are then electrically coagulated or suture ligated.

Using a microscope, muscles in back of the leg (near the semitendinosis and adductors) are bluntly dissected. The popliteal lymph node is then located. The 2 proximal and 2 distal lymphatic vessels and distal blood supply of the popliteal node are then ligated by suturing. The popliteal lymph node, and any accompanying adipose tissue, is then removed by cuffing connective tissues.

Care is taken to control any mild bleeding resulting from this procedure. After lymphatics are occluded, the skin flaps are sealed by using liquid skin (Vetbond) (A J Buck). The separated skin edges are sealed to the underlying muscle tissue while leaving a gap of ~0.5 cm around the leg. Skin also may be anchored by suturing to underlying muscle when necessary.

To avoid infection, animals are housed individually with mesh (no bedding). Recovering animals are checked daily through the optimal edematous peak, which typically occurred by day 5-7. The plateau edematous peak are then observed. To evaluate the intensity of the lymphedema, the circumference and volumes of 2 designated places on each paw before operation and daily for 7 days are measured. The effect of plasma proteins on lymphedema is determined and whether protein analysis is a useful testing perimeter is also investigated. The weights of both control and edematous limbs are evaluated at 2 places. Analysis is performed in a blind manner.

Circumference Measurements: Under brief gas anesthetic to prevent limb movement, a cloth tape is used to measure limb circumference. Measurements are done at the ankle bone and dorsal paw by 2 different people and those 2 readings are averaged. Readings are taken from both control and edematous limbs.

Volumetric Measurements: On the day of surgery, animals are anesthetized with Pentobarbital and are tested prior to surgery. For daily volumetrics animals are under brief halothane anesthetic (rapid immobilization and quick recovery), and both legs are shaved and equally marked using waterproof marker on legs. Legs are first dipped in water, then dipped into instrument to each marked level then measured by Buxco edema software (Chen/Victor). Data is recorded by one person, while the other is dipping the limb to marked area.

Blood-plasma protein measurements: Blood is drawn, spun, and serum separated prior to surgery and then at conclusion for total protein and $Ca^{2+}$ comparison.

Limb Weight Comparison: After drawing blood, the animal is prepared for tissue collection. The limbs are amputated using a quillitine, then both experimental and control legs are cut at the ligature and weighed. A second weighing is done as the tibio-cacaneal joint is disarticulated and the foot is weighed.

Histological Preparations: The transverse muscle located behind the knee (popliteal) area is dissected and arranged in a metal mold, filled with freezeGel, dipped into cold methylbutane, placed into labeled sample bags at −80EC until sectioning. Upon sectioning, the muscle is observed under fluorescent microscopy for lymphatics.

The studies described in this example tested activity of agonists or antagonists of the invention. However, one skilled in the art could easily modify the exemplified studies to test the activity of polynucleotides or polypeptides of the invention (e.g., gene therapy).

Example 29

Suppression of TNF Alpha-Induced Adhesion Molecule Expression by an Agonist or Antagonist of the Invention The recruitment of lymphocytes to areas of inflammation and angiogenesis involves specific receptor-ligand interactions between cell surface adhesion molecules (CAMs) on lymphocytes and the vascular endothelium. The adhesion process, in both normal and pathological settings, follows a multi-step cascade that involves intercellular adhesion molecule-1 (ICAM-1), vascular cell adhesion molecule-1 (VCAM-1), and endothelial leukocyte adhesion molecule-1 (E-selectin) expression on endothelial cells (EC). The expression of these molecules and others on the vascular endothelium determines the efficiency with which leukocytes may adhere to the local vasculature and extravasate into the local tissue during the development of an inflammatory response. The local concentration of cytokines and growth factor participate in the modulation of the expression of these CAMs.

Tumor necrosis factor alpha (TNF-a), a potent proinflammatory cytokine, is a stimulator of all three CAMs on endothelial cells and may be involved in a wide variety of inflammatory responses, often resulting in a pathological outcome.

The potential of an agonist or antagonist of the invention to mediate a suppression of TNF-a induced CAM expression can be examined. A modified ELISA assay which uses ECs as a solid phase absorbent is employed to measure the amount of CAM expression on TNF-a treated ECs when co-stimulated with a member of the FGF family of proteins.

To perform the experiment, human umbilical vein endothelial cell (HUVEC) cultures are obtained from pooled cord harvests and maintained in growth medium (EGM-2; Clonetics, San Diego, Calif.) supplemented with 10% FCS and 1% penicillin/streptomycin in a 37 degree C. humidified incubator containing 5% $CO_2$. HUVECs are seeded in 96-well plates at concentrations of $1 \times 10^4$ cells/well in EGM medium at 37 degree C. for 18-24 hrs or until confluent. The monolayers are subsequently washed 3 times with a serum-free solution of RPMI-1640 supplemented with 100 U/ml penicillin and 100 mg/ml streptomycin, and treated with a given cytokine and/or growth factor(s) for 24 h at 37 degree C. Following incubation, the cells are then evaluated for CAM expression.

Human Umbilical Vein Endothelial cells (HUVECs) are grown in a standard 96 well plate to confluence. Growth medium is removed from the cells and replaced with 90 ul of 199 Medium (10% FBS). Samples for testing and positive or negative controls are added to the plate in triplicate (in 10 ul volumes). Plates are incubated at 37 degree C. for either 5 h (selectin and integrin expression) or 24 h (integrin expression only). Plates are aspirated to remove medium and 100 μl of 0.1% paraformaldehyde-PBS (with Ca++ and Mg++) is added to each well. Plates are held at 4° C. for 30 min.

Fixative is then removed from the wells and wells are washed 1× with PBS(+Ca,Mg)+0.5% BSA and drained. Do not allow the wells to dry. Add 10 μl of diluted primary antibody to the test and control wells. Anti-ICAM-1-Biotin, Anti-VCAM-1-Biotin and Anti-E-selectin-Biotin are used at a concentration of 10 μg/ml (1:10 dilution of 0.1 mg/ml stock antibody). Cells are incubated at 37° C. for 30 min. in a humidified environment. Wells are washed X3 with PBS(+Ca,Mg)+0.5% BSA.

Then add 20 μl of diluted EXTRAVIDIN™-Alkaline Phosphotase (1:5,000 dilution) to each well and incubated at 37° C. for 30 min. Wells are washed X3 with PBS(+Ca,Mg)+0.5% BSA. 1 tablet of p-Nitrophenol Phosphate pNPP is dissolved in 5 ml of glycine buffer (pH 10.4). 100 μl of pNPP substrate in glycine buffer is added to each test well. Standard wells in triplicate are prepared from the working dilution of the EXTRAVIDIN™-Alkaline Phosphotase in glycine buffer: 1:5,000 $(10^0) > 10^{-0.05} > 10^{-1 > 10^{-1.5}}$.5 μl of each dilution is added to triplicate wells and the resulting AP content in each well is 5.50 ng, 1.74 ng, 0.55 ng, 0.18 ng. 100 μl of pNNP reagent must then be added to each of the standard wells. The plate must be incubated at 37° C. for 4 h. A volume of 50 μl of 3M NaOH is added to all wells. The results are quantified on a plate reader at 405 nm. The background subtraction option is used on blank wells filled with glycine buffer only. The template is set up to indicate the concentration of AP-conjugate in each standard well [5.50 ng; 1.74 ng; 0.55 ng; 0.18 ng]. Results are indicated as amount of bound AP-conjugate in each sample.

The studies described in this example tested activity of agonists or antagonists of the invention. However, one skilled in the art could easily modify the exemplified studies to test the activity of polynucleotides or polypeptides of the invention (e.g., gene therapy).

Example 30

Production of Polypeptide of the Invention for High-Throughput Screening Assays

The following protocol produces a supernatant containing polypeptide of the present invention to be tested. This supernatant can then be used in the Screening Assays described in Examples 32-41.

First, dilute Poly-D-Lysine (644 587 Boehringer-Mannheim) stock solution (1 mg/ml in PBS) 1:20 in PBS (w/o calcium or magnesium 17-516F Biowhittaker) for a working solution of 50 ug/ml. Add 200 ul of this solution to each well (24 well plates) and incubate at RT for 20 minutes. Be sure to distribute the solution over each well (note: a 12-channel pipetter may be used with tips on every other channel). Aspirate off the Poly-D-Lysine solution and rinse with 1 ml PBS (Phosphate Buffered Saline). The PBS should remain in the well until just prior to plating the cells and plates may be poly-lysine coated in advance for up to two weeks.

Plate 293T cells (do not carry cells past P+20) at $2 \times 10^5$ cells/well in 0.5 ml DMEM (Dulbecco's Modified Eagle Medium)(with 4.5 G/L glucose and L-glutamine (12-604F Biowhittaker))/10% heat inactivated FBS (14-503F Biowhittaker)/1× Penstrep(17-602E Biowhittaker). Let the cells grow overnight.

The next day, mix together in a sterile solution basin: 300 ul Lipofectamine (18324-012 Gibco/BRL) and 5 ml Optimem I (31985070 Gibco/BRL)/96-well plate. With a small volume multi-channel pipetter, aliquot approximately 2 ug of an expression vector containing a polynucleotide insert, produced by the methods described in Examples 8-10, into an appropriately labeled 96-well round bottom plate. With a multi-channel pipetter, add 50 ul of the Lipofectamine/Optimem I mixture to each well. Pipette up and down gently to mix. Incubate at RT 15-45 minutes. After about 20 minutes, use a multi-channel pipetter to add 150 ul Optimem I to each well. As a control, one plate of vector DNA lacking an insert should be transfected with each set of transfections.

Preferably, the transfection should be performed by tag-teaming the following tasks. By tag-teaming, hands on time is cut in half, and the cells do not spend too much time on PBS. First, person A aspirates off the media from four 24-well plates of cells, and then person B rinses each well with 0.5-1 ml PBS. Person A then aspirates off PBS rinse, and person B, using a 12-channel pipetter with tips on every other channel, adds the 200 ul of DNA/Lipofectamine/Optimem I complex to the odd wells first, then to the even wells, to each row on the 24-well plates. Incubate at 37 degree C. for 6 hours.

While cells are incubating, prepare appropriate media, either 1% BSA in DMEM with 1× penstrep, or HGS CHO-5 media (116.6 mg/L of CaCl2 (anhyd); 0.00130 mg/L $CuSO_4$-$5H_2O$; 0.050 mg/L of $Fe(NO_3)_3$-$9H_2O$; 0.417 mg/L of $FeSO_4$-$7H_2O$; 311.80 mg/L of Kcl; 28.64 mg/L of $MgCl_2$; 48.84 mg/L of $MgSO_4$; 6995.50 mg/L of NaCl; 2400.0 mg/L of $NaHCO_3$; 62.50 mg/L of $NaH_2PO_4$—$H_2O$; 71.02 mg/L of $Na_2HPO4$; 0.4320 mg/L of $ZnSO_4$-$7H_2O$; 0.002 mg/L of Arachidonic Acid; 1.022 mg/L of Cholesterol; 0.070 mg/L of DL-alpha-Tocopherol-Acetate; 0.0520 mg/L of Linoleic Acid; 0.010 mg/L of Linolenic Acid; 0.010 mg/L of Myristic Acid; 0.010 mg/L of Oleic Acid; 0.010 mg/L of Palmitric Acid; 0.010 mg/L of Palmitic Acid; 100 mg/L of Pluronic F-68; 0.010 mg/L of Stearic Acid; 2.20 mg/L of Tween 80; 4551 mg/L of D-Glucose; 130.85 mg/ml of L-Alanine; 147.50 mg/ml of L-Arginine-HCL; 7.50 mg/ml of L-Asparagine-H$_2$0; 6.65 mg/ml of L-Aspartic Acid; 29.56 mg/ml of L-Cystine-2HCL-H$_2$O; 31.29 mg/ml of L-Cystine-2HCL; 7.35 mg/ml of L-Glutamic Acid; 365.0 mg/ml of L-Glutamine; 18.75 mg/ml of Glycine; 52.48 mg/ml of L-Histidine-HCL-H$_2$0; 106.97 mg/ml of L-Isoleucine; 111.45 mg/ml of L-Leucine; 163.75 mg/ml of L-Lysine HCL; 32.34 mg/ml of L-Methionine; 68.48 mg/ml of L-Phenylalainine; 40.0 mg/ml of L-Proline; 26.25 mg/ml of L-Serine; 101.05 mg/ml of L-Threonine; 19.22 mg/ml of L-Tryptophan; 91.79 mg/ml of L-Tryrosine-2Na-2H$_2$0; and 99.65 mg/ml of L-Valine; 0.0035 mg/L of Biotin; 3.24 mg/L of D-Ca Pantothenate; 11.78 mg/L of Choline Chloride; 4.65 mg/L of Folic Acid; 15.60 mg/L of i-Inositol; 3.02 mg/L of Niacinamide; 3.00 mg/L of Pyridoxal HCL; 0.031 mg/L of Pyridoxine HCL; 0.319 mg/L of Riboflavin; 3.17 mg/L of Thiamine HCL; 0.365 mg/L of Thymidine; 0.680 mg/L of Vitamin B$_{12}$; 25 mM of HEPES Buffer; 2.39 mg/L of Na Hypoxanthine; 0.105 mg/L of Lipoic Acid; 0.081 mg/L of Sodium Putrescine-2HCL; 55.0 mg/L of Sodium Pyruvate; 0.0067 mg/L of Sodium Selenite; 20 uM of Ethanolamine; 0.122 mg/L of Ferric Citrate; 41.70 mg/L of Methyl-B-Cyclodextrin complexed with Linoleic Acid; 33.33 mg/L of Methyl-B-Cyclodextrin complexed with Oleic Acid; 10 mg/L of Methyl-B-Cyclodextrin complexed with Retinal Acetate. Adjust osmolarity to 327 mOsm with 2 mm glutamine and 1× penstrep. (BSA (81-068-3 Bayer) 100 gm dissolved in IL DMEM for a 10% BSA stock solution). Filter the media and collect 50 ul for endotoxin assay in 15 ml polystyrene conical.

The transfection reaction is terminated, preferably by tag-teaming, at the end of the incubation period. Person A aspirates off the transfection media, while person B adds 1.5 ml appropriate media to each well. Incubate at 37 degree C. for 45 or 72 hours depending on the media used: 1% BSA for 45 hours or CHO-5 for 72 hours.

On day four, using a 300 ul multichannel pipetter, aliquot 600 ul in one 1 ml deep well plate and the remaining supernatant into a 2 ml deep well. The supernatants from each well can then be used in the assays described in Examples 32-39.

It is specifically understood that when activity is obtained in any of the assays described below using a supernatant, the activity originates from either the polypeptide of the present invention directly (e.g., as a secreted protein) or by polypeptide of the present invention inducing expression of other proteins, which are then secreted into the supernatant. Thus, the invention further provides a method of identifying the protein in the supernatant characterized by an activity in a particular assay.

Example 31

Construction of GAS Reporter Construct

One signal transduction pathway involved in the differentiation and proliferation of cells is called the Jaks-STATs pathway. Activated proteins in the Jaks-STATs pathway bind to gamma activation site "GAS" elements or interferon-sensitive responsive element ("ISRE"), located in the promoter of many genes. The binding of a protein to these elements alter the expression of the associated gene.

GAS and ISRE elements are recognized by a class of transcription factors called Signal Transducers and Activators of Transcription, or "STATs." There are six members of the STATs family. Stat1 and Stat3 are present in many cell types, as is Stat2 (as response to IFN-alpha is widespread). Stat4 is more restricted and is not in many cell types though it has been found in T helper class I, cells after treatment with IL-12. Stat5 was originally called mammary growth factor, but has been found at higher concentrations in other cells including myeloid cells. It can be activated in tissue culture cells by many cytokines.

The STATs are activated to translocate from the cytoplasm to the nucleus upon tyrosine phosphorylation by a set of kinases known as the Janus Kinase ("Jaks") family. Jaks represent a distinct family of soluble tyrosine kinases and include Tyk2, Jak1, Jak2, and Jak3. These kinases display significant sequence similarity and are generally catalytically inactive in resting cells.

The Jaks are activated by a wide range of receptors summarized in the Table below. (Adapted from review by Schidler and Darnell, Ann. Rev. Biochem. 64:621-51 (1995)). A cytokine receptor family, capable of activating Jaks, is divided into two groups: (a) Class 1 includes receptors for IL-2, IL-3, IL-4, IL-6, IL-7, IL-9, IL-11, IL-12, IL-15, Epo, PRL, GH, G-CSF, GM-CSF, LIF, CNTF, and thrombopoietin; and (b) Class 2 includes IFN-a, IFN-g, and IL-10. The Class 1 receptors share a conserved cysteine motif (a set of four conserved cysteines and one tryptophan) and a WSXWS motif (a membrane proximal region encoding Trp-Ser-Xaa-Trp-Ser (SEQ ID NO: 2)).

Thus, on binding of a ligand to a receptor, Jaks are activated, which in turn activate STATs, which then translocate and bind to GAS elements. This entire process is encompassed in the Jaks-STATs signal transduction pathway. Therefore, activation of the Jaks-STATs pathway, reflected by the binding of the GAS or the ISRE element, can be used to indicate proteins involved in the proliferation and differentiation of cells. For example, growth factors and cytokines are known to activate the Jaks-STATs pathway (See Table below). Thus, by using GAS elements linked to reporter molecules, activators of the Jaks-STATs pathway can be identified.

| Ligand | JAKs | | | | STATS | GAS(elements) or ISRE |
| --- | --- | --- | --- | --- | --- | --- |
| | tyk2 | Jak1 | Jak2 | Jak3 | | |
| IFN family | | | | | | |
| IFN-a/B | + | + | − | − | 1, 2, 3 | ISRE |
| IFN-g | | + | + | − | 1 | GAS (IRF1 > Lys6 > IFP) |
| Il-10 | + | ? | ? | − | 1, 3 | |
| gp130 family | | | | | | |
| IL-6 (Pleiotropic) | + | + | + | ? | 1, 3 | GAS (IRF1 > Lys6 > IFP) |

-continued

| | | JAKs | | | | |
|---|---|---|---|---|---|---|
| Ligand | tyk2 | Jak1 | Jak2 | Jak3 | STATS | GAS(elements) or ISRE |
| Il-11 (Pleiotropic) | ? | + | ? | ? | 1, 3 | |
| OnM (Pleiotropic) | ? | + | + | ? | 1, 3 | |
| LIF (Pleiotropic) | ? | + | + | ? | 1, 3 | |
| CNTF (Pleiotropic) | −/+ | + | + | ? | 1, 3 | |
| G-CSF (Pleiotropic) | ? | + | ? | ? | 1, 3 | |
| IL-12 (Pleiotropic) | + | − | + | + | 1, 3 | |
| g-C family | | | | | | |
| IL-2 (lymphocytes) | − | + | − | + | 1, 3, 5 | GAS |
| IL-4 (lymph/myeloid) | − | + | − | + | 6 | GAS (IRF1 = IFP >> Ly6)(IgH) |
| IL-7 (lymphocytes) | − | + | − | + | 5 | GAS |
| IL-9 (lymphocytes) | − | + | − | + | 5 | GAS |
| IL-13 (lymphocyte) | − | + | ? | ? | 6 | GAS |
| IL-15 | ? | + | ? | + | 5 | GAS |
| gp140 family | | | | | | |
| IL-3 (myeloid) | − | − | + | − | 5 | GAS (IRF1 > IFP >> Ly6) |
| IL-5 (myeloid) | − | − | + | − | 5 | GAS |
| GM-CSF (myeloid) | − | − | + | − | 5 | GAS |
| Growth hormone family | | | | | | |
| GH | ? | − | + | − | 5 | |
| PRL | ? | +/− | + | − | 1, 3, 5 | |
| EPO | ? | − | + | − | 5 | GAS(B-CAS > IRF1 = IFP >> Ly6) |
| Receptor Tyrosine Kinases | | | | | | |
| EGF | ? | + | + | − | 1, 3 | GAS (IRF1) |
| PDGF | ? | + | + | − | 1, 3 | |
| CSF-1 | ? | + | + | − | 1, 3 | GAS (not IRF1) |

To construct a synthetic GAS containing promoter element, which is used in the Biological Assays described in Examples 32-33, a PCR based strategy is employed to generate a GAS-SV40 promoter sequence. The 5' primer contains four tandem copies of the GAS binding site found in the IRF1 promoter and previously demonstrated to bind STATs upon induction with a range of cytokines (Rothman et al., Immunity 1:457-468 (1994).), although other GAS or ISRE elements can be used instead. The 5' primer also contains 18 bp of sequence complementary to the SV40 early promoter sequence and is flanked with an XhoI site. The sequence of the 5' primer is:

(SEQ ID NO:3)
5':GCGCCTCGAGATTTCCCCGAAATCTAGATTTCCCCGAAATGATTTCCC

CGAAATGATTTCCCCGAAATATCTGCCATCTCAATTAG:3'

The downstream primer is complementary to the SV40 promoter and is flanked with a Hind III site: 5':GCG-GCAAGCTTTTTGCAAAGCCTAGGC:3' (SEQ ID NO: 4)

PCR amplification is performed using the SV40 promoter template present in the B-gal:promoter plasmid obtained from CLONTECH™. The resulting PCR fragment is digested with XhoI/Hind III and subcloned into BLSK2-. (Stratagene.) Sequencing with forward and reverse primers confirms that the insert contains the following sequence:

(SEQ ID NO:5)
5':CTCGAGATTTCCCCGAAATCTAGATTTCCCCGAAATGATTTCCCCGAA

ATGATTTCCCCGAAATATCTGCCATCTCAATTAGTCAGCAACCATAGTCCC

GCCCCTAACTCCGCCCATCCCGCCCCTAACTCCGCCCAGTTCCGCCCATTC

TCCGCCCCATGGCTGACTAATTTTTTTTATTTATGCAGAGGCCGAGGCCGC

CTCGGCCTCTGAGCTATTCCAGAAGTAGTGAGGAGGCTTTTTTGGAGGCCT

AGGCTTTTGCAAAAAGCTT:3'

With this GAS promoter element linked to the SV40 promoter, a GAS:SEAP2 reporter construct is next engineered. Here, the reporter molecule is a secreted alkaline phosphatase, or "SEAP." Clearly, however, any reporter molecule can be instead of SEAP, in this or in any of the other Examples. Well known reporter molecules that can be used instead of SEAP include chloramphenicol acetyltransferase (CAT), luciferase, alkaline phosphatase, B-galactosidase, green fluorescent protein (GFP), or any protein detectable by an antibody.

The above sequence confirmed synthetic GAS-SV40 promoter element is subcloned into the pSEAP-Promoter vector obtained from CLONTECH™ using HindIII and XhoI, effectively replacing the SV40 promoter with the amplified GAS:SV40 promoter element, to create the GAS-SEAP vector. However, this vector does not contain a neomycin resistance gene, and therefore, is not preferred for mammalian expression systems.

Thus, in order to generate mammalian stable cell lines expressing the GAS-SEAP reporter, the GAS-SEAP cassette is removed from the GAS-SEAP vector using SalI and NotI, and inserted into a backbone vector containing the neomycin resistance gene, such as pGFP-1 (CLONTECH™), using these restriction sites in the multiple cloning site, to create the GAS-SEAP/Neo vector. Once this vector is transfected into mammalian cells, this vector can then be used as a reporter molecule for GAS binding as described in Examples 32-33.

Other constructs can be made using the above description and replacing GAS with a different promoter sequence. For example, construction of reporter molecules containing EGR and NF-KB promoter sequences are described in Examples 34 and 35. However, many other promoters can be substituted using the protocols described in these Examples. For instance, SRE, IL-2, NFAT, or Osteocalcin promoters can be substituted, alone or in combination (e.g., GAS/NF-KB/EGR, GAS/NF-KB, Il-2/NFAT, or NP-KB/GAS). Similarly, other cell lines can be used to test reporter construct activity, such as HELA (epithelial), HLTVEC (endothelial), Reh (B-cell), Saos-2 (osteoblast), HUVAC (aortic), or Cardiomyocyte.

Example 32

High-Throughput Screening Assay for T-Cell Activity

The following protocol is used to assess T-cell activity by identifying factors, and determining whether supernate containing a polypeptide of the invention proliferates and/or differentiates T-cells. T-cell activity is assessed using the GAS/SEAP/Neo construct produced in Example 31. Thus, factors that increase SEAP activity indicate the ability to activate the Jaks-STATS signal transduction pathway. The T-cell used in this assay is Jurkat T-cells (ATCC™ Accession No. TIB-152), although Molt-3 cells (ATCC™ Accession No. CRL-1552) and Molt-4 cells (ATCC™ Accession No. CRL-1582) cells can also be used.

Jurkat T-cells are lymphoblastic CD4+ Th1 helper cells. In order to generate stable cell lines, approximately 2 million Jurkat cells are transfected with the GAS-SEAP/neo vector using DMRIE-C (Life Technologies)(transfection procedure described below). The transfected cells are seeded to a density of approximately 20,000 cells per well and transfectants resistant to 1 mg/ml genticin selected. Resistant colonies are expanded and then tested for their response to increasing concentrations of interferon gamma. The dose response of a selected clone is demonstrated.

Specifically, the following protocol will yield sufficient cells for 75 wells containing 200 ul of cells. Thus, it is either scaled up, or performed in multiple to generate sufficient cells for multiple 96 well plates. Jurkat cells are maintained in RPMI+10% serum with 1% Pen-Strep. Combine 2.5 mls of OPTI-MEM™ (Life Technologies) with 10 ug of plasmid DNA in a T25 flask. Add 2.5 ml OPTI-MEM™ containing 50 ul of DMRIE-C and incubate at room temperature for 15-45 mins.

During the incubation period, count cell concentration, spin down the required number of cells ($10^7$ per transfection), and resuspend in OPTI-MEM™ to a final concentration of $10^7$ cells/ml. Then add 1 ml of $1 \times 10^7$ cells in OPTI-MEM™ to T25 flask and incubate at 37 degree C. for 6 hrs. After the incubation, add 10 ml of RPMI+15% serum.

The Jurkat:GAS-SEAP stable reporter lines are maintained in RPMI+10% serum, 1 mg/ml Genticin, and 1% Pen-Strep. These cells are treated with supernatants containing polypeptide of the present invention or polypeptide of the present invention induced polypeptides as produced by the protocol described in Example 30.

On the day of treatment with the supernatant, the cells should be washed and resuspended in fresh RPMI+10% serum to a density of 500,000 cells per ml. The exact number of cells required will depend on the number of supernatants being screened. For one 96 well plate, approximately 10 million cells (for 10 plates, 100 million cells) are required.

Transfer the cells to a triangular reservoir boat, in order to dispense the cells into a 96 well dish, using a 12 channel pipette. Using a 12 channel pipette, transfer 200 ul of cells into each well (therefore adding 100,000 cells per well).

After all the plates have been seeded, 50 ul of the supernatants are transferred directly from the 96 well plate containing the supernatants into each well using a 12 channel pipette. In addition, a dose of exogenous interferon gamma (0.1, 1.0, 10 ng) is added to wells H9, H10, and H11 to serve as additional positive controls for the assay.

The 96 well dishes containing Jurkat cells treated with supernatants are placed in an incubator for 48 hrs (note: this time is variable between 48-72 hrs). 35 ul samples from each well are then transferred to an opaque 96 well plate using a 12 channel pipette. The opaque plates should be covered (using sellophene covers) and stored at −20 degree C. until SEAP assays are performed according to Example 36. The plates containing the remaining treated cells are placed at 4 degree C. and serve as a source of material for repeating the assay on a specific well if desired.

As a positive control, 100 Unit/ml interferon gamma can be used which is known to activate Jurkat T cells. Over 30 fold induction is typically observed in the positive control wells.

The above protocol may be used in the generation of both transient, as well as, stable transfected cells, which would be apparent to those of skill in the art.

Example 33

High-Throughput Screening Assay Identifying Myeloid Activity

The following protocol is used to assess myeloid activity of polypeptide of the present invention by determining whether polypeptide of the present invention proliferates and/or differentiates myeloid cells. Myeloid cell activity is assessed using the GAS/SEAP/Neo construct produced in Example 31. Thus, factors that increase SEAP activity indicate the ability to activate the Jaks-STATS signal transduction pathway. The myeloid cell used in this assay is U937, a pre-monocyte cell line, although TF-1, HL60, or KG1 can be used.

To transiently transfect U937 cells with the GAS/SEAP/Neo construct produced in Example 31, a DEAE-Dextran method (Kharbanda et. al., 1994, Cell Growth & Differentiation, 5:259-265) is used. First, harvest $2 \times 10^7$ U937 cells and wash with PBS. The U937 cells are usually grown in RPMI 1640 medium containing 10% heat-inactivated fetal bovine serum (FBS) supplemented with 100 units/ml penicillin and 100 mg/ml streptomycin.

Next, suspend the cells in 1 ml of 20 mM Tris-HCl (pH 7.4) buffer containing 0.5 mg/ml DEAE-Dextran, 8 ug GAS-SEAP2 plasmid DNA, 140 mM NaCl, 5 mM KCl, 375 uM $Na_2HPO_4.7H_2O$, 1 mM $MgCl_2$, and 675 uM $CaCl_2$. Incubate at 37 degrees C. for 45 min.

Wash the cells with RPMI 1640 medium containing 10% FBS and then resuspend in 10 ml complete medium and incubate at 37 degree C. for 36 hr.

The GAS-SEAP/U937 stable cells are obtained by growing the cells in 400 ug/ml G418. The G418-free medium is used for routine growth but every one to two months, the cells should be re-grown in 400 ug/ml G418 for couple of passages.

These cells are tested by harvesting $1 \times 10^8$ cells (this is enough for ten 96-well plates assay) and wash with PBS. Suspend the cells in 200 ml above described growth medium, with a final density of $5 \times 10^5$ cells/ml. Plate 200 ul cells per well in the 96-well plate (or $1 \times 10^5$ cells/well).

Add 50 ul of the supernatant prepared by the protocol described in Example 30. Incubate at 37 degree C. for 48 to 72 hr. As a positive control, 100 Unit/ml interferon gamma can be used which is known to activate U937 cells. Over 30 fold induction is typically observed in the positive control wells. SEAP assay the supernatant according to the protocol described in Example 36.

Example 34

High-Throughput Screening Assay Identifying Neuronal Activity

When cells undergo differentiation and proliferation, a group of genes are activated through many different signal transduction pathways. One of these genes, EGRL (early growth response gene 1), is induced in various tissues and cell types upon activation. The promoter of EGRL is responsible for such induction. Using the EGRL promoter linked to reporter molecules, activation of cells can be assessed by polypeptide of the present invention.

Particularly, the following protocol is used to assess neuronal activity in PC12 cell lines. PC12 cells (rat phenochromocytoma cells) are known to proliferate and/or differentiate by activation with a number of mitogens, such as TPA (tetradecanoyl phorbol acetate), NGF (nerve growth factor), and EGF (epidermal growth factor). The EGR1 gene expression is activated during this treatment. Thus, by stably transfecting PC12 cells with a construct containing an EGR promoter linked to SEAP reporter, activation of PC12 cells by polypeptide of the present invention can be assessed.

The EGR/SEAP reporter construct can be assembled by the following protocol. The EGR-1 promoter sequence (–633 to +1)(Sakamoto K et al., Oncogene 6:867-871 (1991)) can be PCR amplified from human genomic DNA using the following primers:

```
                                          (SEQ ID NO:6)
5' GCGCTCGAGGGATGACAGCGATAGAACCCCGG-3'

(SEQ ID NO:7)
5' GCGAAGCTTCGCGACTCCCCGGATCCGCCTC-3'
```

Using the GAS:SEAP/Neo vector produced in Example 31, EGR1 amplified product can then be inserted into this vector. Linearize the GAS:SEAP/Neo vector using restriction enzymes XhoI/HindIII, removing the GAS/SV40 stuffer. Restrict the EGR1 amplified product with these same enzymes. Ligate the vector and the EGR1 promoter.

To prepare 96 well-plates for cell culture, two mls of a coating solution (1:30 dilution of collagen type I (Upstate Biotech Inc. Cat#08-115) in 30% ethanol (filter sterilized)) is added per one 10 cm plate or 50 ml per well of the 96-well plate, and allowed to air dry for 2 hr.

PC12 cells are routinely grown in RPMI-1640 medium (Bio Whittaker) containing 10% horse serum (JRH BIOSCIENCES, Cat. # 12449-78P), 5% heat-inactivated fetal bovine serum (FBS) supplemented with 100 units/ml penicillin and 100 ug/ml streptomycin on a precoated 10 cm tissue culture dish. One to four split is done every three to four days. Cells are removed from the plates by scraping and resuspended with pipetting up and down for more than 15 times.

Transfect the EGR/SEAP/Neo construct into PC12 using the Lipofectamine protocol described in Example 30. EGR-SEAP/PC12 stable cells are obtained by growing the cells in 300 ug/ml G418. The G418-free medium is used for routine growth but every one to two months, the cells should be re-grown in 300 ug/ml G418 for couple of passages.

To assay for neuronal activity, a 10 cm plate with cells around 70 to 80% confluent is screened by removing the old medium. Wash the cells once with PBS (Phosphate buffered saline). Then starve the cells in low serum medium (RPMI-1640 containing 1% horse serum and 0.5% FBS with antibiotics) overnight.

The next morning, remove the medium and wash the cells with PBS. Scrape off the cells from the plate, suspend the cells well in 2 ml low serum medium. Count the cell number and add more low serum medium to reach final cell density as $5 \times 10^5$ cells/ml.

Add 200 ul of the cell suspension to each well of 96-well plate (equivalent to $1 \times 10^5$ cells/well). Add 50 ul supernatant produced by Example 30, 37 degree C. for 48 to 72 hr. As a positive control, a growth factor known to activate PC12 cells through EGR can be used, such as 50 ng/ul of Neuronal Growth Factor (NGF). Over fifty-fold induction of SEAP is typically seen in the positive control wells. SEAP assay the supernatant according to Example 36.

Example 35

High-Throughput Screening Assay for T-Cell Activity

NF-KB (Nuclear Factor KB) is a transcription factor activated by a wide variety of agents including the inflammatory cytokines IL-1 and TNF, CD30 and CD40, lymphotoxin-alpha and lymphotoxin-beta, by exposure to LPS or thrombin, and by expression of certain viral gene products. As a transcription factor, NF-KB regulates the expression of genes involved in immune cell activation, control of apoptosis (NF-B appears to shield cells from apoptosis), B and T-cell development, anti-viral and antimicrobial responses, and multiple stress responses.

In non-stimulated conditions, NF-KB is retained in the cytoplasm with I-KB (Inhibitor KB). However, upon stimulation, I-KB is phosphorylated and degraded, causing NF-KB to shuttle to the nucleus, thereby activating transcription of target genes. Target genes activated by NF-KB include IL-2, IL-6, GM-CSF, ICAM-1 and class I MHC.

Due to its central role and ability to respond to a range of stimuli, reporter constructs utilizing the NF-KB promoter element are used to screen the supernatants produced in Example 30. Activators or inhibitors of NF-KB would be useful in treating, preventing, and/or diagnosing diseases. For example, inhibitors of NF-KB could be used to treat those diseases related to the acute or chronic activation of NF-KB, such as rheumatoid arthritis.

To construct a vector containing the NF-KB promoter element, a PCR based strategy is employed. The upstream primer contains four tandem copies of the NF-KB binding site (GGGGACTTTCCC) (SEQ ID NO: 8), 18 bp of sequence complementary to the 5' end of the SV40 early promoter sequence, and is flanked with an XhoI site:

```
5':GCGGCCTCGAGGGGACTTTCCCGGGGACTTTCCGGGGACTTTCCGGGA

CTTTCCATCCTGCCATCTCAATTAG:3' (SEQ ID NO:9)
```

The downstream primer is complementary to the 3' end of the SV40 promoter and is flanked with a Hind III site:

5':GCGGCAAGCTTTTTGCAAAGCCTAGGC:3'(SEQ ID NO.4)

PCR amplification is performed using the SV40 promoter template present in the pB-gal:promoter plasmid obtained from CLONTECH™. The resulting PCR fragment is digested with XhoI and Hind III and subcloned into BLSK2-. (Stratagene) Sequencing with the T7 and T3 primers confirms the insert contains the following sequence:

5':CTCGAGGGGACTTTCCCGGGGACTTTCCGGGGACTTTCCGGGACTTTC

CATCTGCCATCTCAATTAGTCAGCAACCATAGTCCCGCCCCTAACTCCGCC

CATCCCGCCCCTAACTCCGCCCAGTTCCGCCCATTCTCCGCCCCATGGCTG

ACTAATTTTTTTATTTATGCAGAGGCCGAGGCCGCCTCGGCCTCTGAGCT

ATTCCAGAAGTAGTGAGGAGGCTTTTTTGGAGGCCTAGGCTTTTGCAAAAA

GCTT:3' (SEQ ID NO:10)

Next, replace the SV40 minimal promoter element present in the pSEAP2-promoter plasmid (CLONTECH™) with this NF-KB/SV40 fragment using XhoI and HindIII. However, this vector does not contain a neomycin resistance gene, and therefore, is not preferred for mammalian expression systems.

In order to generate stable mammalian cell lines, the NF-KB/SV40/SEAP cassette is removed from the above NF-KB/SEAP vector using restriction enzymes SalI and NotI, and inserted into a vector containing neomycin resistance. Particularly, the NF-KB/SV40/SEAP cassette was inserted into pGFP-1 (CLONTECH™), replacing the GFP gene, after restricting pGFP-1 with SalI and NotI.

Once NF-KB/SV40/SEAP/Neo vector is created, stable Jurkat T-cells are created and maintained according to the protocol described in Example 32. Similarly, the method for assaying supernatants with these stable Jurkat T-cells is also described in Example 32. As a positive control, exogenous TNF alpha (0.1, 1, 10 ng) is added to wells H9, H10, and H11, with a 5-10 fold activation typically observed.

Example 36

Assay for SEAP Activity

As a reporter molecule for the assays described in Examples 32-35, SEAP activity is assayed using the Tropix Phospho-light Kit (Cat. BP-400) according to the following general procedure. The Tropix Phospho-light Kit supplies the Dilution, Assay, and Reaction Buffers used below.

Prime a dispenser with the 2.5× Dilution Buffer and dispense 15 ul of 2.5× dilution buffer into Optiplates containing 35 ul of a supernatant. Seal the plates with a plastic sealer and incubate at 65 degree C. for 30 min. Separate the Optiplates to avoid uneven heating.

Cool the samples to room temperature for 15 minutes. Empty the dispenser and prime with the Assay Buffer. Add 50 ml Assay Buffer and incubate at room temperature 5 min. Empty the dispenser and prime with the Reaction Buffer (see the Table below). Add 50 ul Reaction Buffer and incubate at room temperature for 20 minutes. Since the intensity of the chemiluminescent signal is time dependent, and it takes about 10 minutes to read 5 plates on a luminometer, thus one should treat 5 plates at each time and start the second set 10 minutes later.

Read the relative light unit in the luminometer. Set H12 as blank, and print the results. An increase in chemiluminescence indicates reporter activity.

| Reaction Buffer Formulation: | | |
|---|---|---|
| # of plates | Rxn buffer diluent (ml) | CSPD (ml) |
| 10 | 60 | 3 |
| 11 | 65 | 3.25 |
| 12 | 70 | 3.5 |
| 13 | 75 | 3.75 |
| 14 | 80 | 4 |
| 15 | 85 | 4.25 |
| 16 | 90 | 4.5 |
| 17 | 95 | 4.75 |
| 18 | 100 | 5 |
| 19 | 105 | 5.25 |
| 20 | 110 | 5.5 |
| 21 | 115 | 5.75 |
| 22 | 120 | 6 |
| 23 | 125 | 6.25 |
| 24 | 130 | 6.5 |
| 25 | 135 | 6.75 |
| 26 | 140 | 7 |
| 27 | 145 | 7.25 |
| 28 | 150 | 7.5 |
| 29 | 155 | 7.75 |
| 30 | 160 | 8 |
| 31 | 165 | 8.25 |
| 32 | 170 | 8.5 |
| 33 | 175 | 8.75 |
| 34 | 180 | 9 |
| 35 | 185 | 9.25 |
| 36 | 190 | 9.5 |
| 37 | 195 | 9.75 |
| 38 | 200 | 10 |
| 39 | 205 | 10.25 |
| 40 | 210 | 10.5 |
| 41 | 215 | 10.75 |
| 42 | 220 | 11 |
| 43 | 225 | 11.25 |
| 44 | 230 | 11.5 |
| 45 | 235 | 11.75 |
| 46 | 240 | 12 |
| 47 | 245 | 12.25 |
| 48 | 250 | 12.5 |
| 49 | 255 | 12.75 |
| 50 | 260 | 13 |

High-Throughput Screening Assay Identifying Changes in Small Molecule Concentration and Membrane Permeability Binding of a ligand to a receptor is known to alter intracellular levels of small molecules, such as calcium, potassium, sodium, and pH, as well as alter membrane potential. These alterations can be measured in an assay to identify supernatants which bind to receptors of a particular cell. Although the following protocol describes an assay for calcium, this protocol can easily be modified to detect changes in potassium, sodium, pH, membrane potential, or any other small molecule which is detectable by a fluorescent probe.

The following assay uses Fluorometric Imaging Plate Reader ("FLIPR") to measure changes in fluorescent molecules (Molecular Probes) that bind small molecules. Clearly, any fluorescent molecule detecting a small molecule can be used instead of the calcium fluorescent molecule, fluo-4 (Molecular Probes, Inc.; catalog no. F-14202), used here.

For adherent cells, seed the cells at 10,000-20,000 cells/well in a Co-star black 96-well plate with clear bottom. The plate is incubated in a $CO_2$ incubator for 20 hours. The adherent cells are washed two times in Biotek washer with 200 ul of HBSS (Hank's Balanced Salt Solution) leaving 100 ul of buffer after the final wash.

A stock solution of 1 mg/ml fluo-4 is made in 10% pluronic acid DMSO. To load the cells with fluo-4, 50 ul of 12 ug/ml fluo-4 is added to each well. The plate is incubated at 37 degrees C. in a CO₂ incubator for 60 min. The plate is washed four times in the Biotek washer with HBSS leaving 100 ul of buffer.

For non-adherent cells, the cells are spun down from culture media. Cells are re-suspended to 2-5×10⁶ cells/ml with HBSS in a 50-ml conical tube. 4 ul of 1 mg/ml fluo-4 solution in 10% pluronic acid DMSO is added to each ml of cell suspension. The tube is then placed in a 37 degrees C. water bath for 30-60 min. The cells are washed twice with HBSS, resuspended to 1×10⁶ cells/ml, and dispensed into a microplate, 100 ul/well. The plate is centrifuged at 1000 rpm for 5 min. The plate is then washed once in Denley Cell Wash with 200 ul, followed by an aspiration step to 100 ul final volume.

For a non-cell based assay, each well contains a fluorescent molecule, such as fluo-4. The supernatant is added to the well, and a change in fluorescence is detected.

To measure the fluorescence of intracellular calcium, the FLIPR is set for the following parameters: (1) System gain is 300-800 mW; (2) Exposure time is 0.4 second; (3) Camera F/stop is F/2; (4) Excitation is 488 nm; (5) Emission is 530 nm; and (6) Sample addition is 50 ul. Increased emission at 530 nm indicates an extracellular signaling event caused by the a molecule, either polypeptide of the present invention or a molecule induced by polypeptide of the present invention, which has resulted in an increase in the intracellular $Ca^{++}$ concentration.

Example 38

High-Throughput Screening Assay Identifying Tyrosine Kinase Activity

The Protein Tyrosine Kinases (PTK) represent a diverse group of transmembrane and cytoplasmic kinases. Within the Receptor Protein Tyrosine Kinase RPTK) group are receptors for a range of mitogenic and metabolic growth factors including the PDGF, FGF, EGF, NGF, HGF and Insulin receptor subfamilies. In addition there are a large family of RPTKs for which the corresponding ligand is unknown. Ligands for RPTKs include mainly secreted small proteins, but also membrane-bound and extracellular matrix proteins.

Activation of RPTK by ligands involves ligand-mediated receptor dimerization, resulting in transphosphorylation of the receptor subunits and activation of the cytoplasmic tyrosine kinases. The cytoplasmic tyrosine kinases include receptor associated tyrosine kinases of the src-family (e.g., src, yes, lck, lyn, fyn) and non-receptor linked and cytosolic protein tyrosine kinases, such as the Jak family, members of which mediate signal transduction triggered by the cytokine superfamily of receptors (e.g., the Interleukins, Interferons, GM-CSF, and Leptin).

Because of the wide range of known factors capable of stimulating tyrosine kinase activity, identifying whether polypeptide of the present invention or a molecule induced by polypeptide of the present invention is capable of activating tyrosine kinase signal transduction pathways is of interest. Therefore, the following protocol is designed to identify such molecules capable of activating the tyrosine kinase signal transduction pathways.

Seed target cells (e.g., primary keratinocytes) at a density of approximately 25,000 cells per well in a 96 well LOPRODYNE™ Silent Screen Plates purchased from Nalge Nunc (Naperville, Ill.). The plates are sterilized with two 30 minute rinses with 100% ethanol, rinsed with water and dried overnight. Some plates are coated for 2 hr with 100 ml of cell culture grade type I collagen (50 mg/ml), gelatin (2%) or polylysine (50 mg/ml), all of which can be purchased from Sigma Chemicals (St. Louis, Mo.) or 10% MATRIGEL™ purchased from Becton Dickinson (Bedford, Mass.), or calf serum, rinsed with PBS and stored at 4 degree C. Cell growth on these plates is assayed by seeding 5,000 cells/well in growth medium and indirect quantitation of cell number through use of ALAMAR BLUE™ as described by the manufacturer Alamar Biosciences, Inc. (Sacramento, Calif.) after 48 hr. Falcon plate covers #3071 from Becton Dickinson (Bedford, Mass.) are used to cover the LOPRODYNE™ Silent Screen Plates. Falcon Microtest III cell culture plates can also be used in some proliferation experiments.

To prepare extracts, A431 cells are seeded onto the nylon membranes of LOPRODYNE™ plates (20,000/200 ml/well) and cultured overnight in complete medium. Cells are quiesced by incubation in serum-free basal medium for 24 hr. After 5-20 minutes treatment with EGF (60 ng/ml) or 50 ul of the supernatant produced in Example 30, the medium was removed and 100 ml of extraction buffer ((20 mM HEPES pH 7.5, 0.15 M NaCl, 1% Triton X-100, 0.1% SDS, 2 mM Na3VO4, 2 mM Na4P2O7 and a cocktail of protease inhibitors (# 1836170) obtained from Boeheringer Mannheim (Indianapolis, Ind.)) is added to each well and the plate is shaken on a rotating shaker for 5 minutes at 4° C. The plate is then placed in a vacuum transfer manifold and the extract filtered through the 0.45 mm membrane bottoms of each well using house vacuum. Extracts are collected in a 96-well catch/assay plate in the bottom of the vacuum manifold and immediately placed on ice. To obtain extracts clarified by centrifugation, the content of each well, after detergent solubilization for 5 minutes, is removed and centrifuged for 15 minutes at 4 degree C. at 16,000×g.

Test the filtered extracts for levels of tyrosine kinase activity. Although many methods of detecting tyrosine kinase activity are known, one method is described here.

Generally, the tyrosine kinase activity of a supernatant is evaluated by determining its ability to phosphorylate a tyrosine residue on a specific substrate (a biotinylated peptide). Biotinylated peptides that can be used for this purpose include PSK1 (corresponding to amino acids 6-20 of the cell division kinase cdc2-p34) and PSK2 (corresponding to amino acids 1-17 of gastrin). Both peptides are substrates for a range of tyrosine kinases and are available from Boehringer Mannheim.

The tyrosine kinase reaction is set up by adding the following components in order. First, add 10 ul of 5 uM Biotinylated Peptide, then 10 ul ATP/Mg$_{2+}$ (5 mM ATP/50 mM MgCl₂), then 10 ul of 5× Assay Buffer (40 mM imidazole hydrochloride, pH7.3, 40 mM beta-glycerophosphate, 1 mM EGTA, 100 mM MgCl₂, 5 mM MnCl₂, 0.5 mg/ml BSA), then 5 ul of Sodium Vanadate (1 mM), and then 5 ul of water. Mix the components gently and preincubate the reaction mix at 30 degree C. for 2 min. Initial the reaction by adding 10 ul of the control enzyme or the filtered supernatant.

The tyrosine kinase assay reaction is then terminated by adding 10 ul of 120 mm EDTA and place the reactions on ice.

Tyrosine kinase activity is determined by transferring 50 ul aliquot of reaction mixture to a microtiter plate (MTP) module and incubating at 37 degree C. for 20 min. This allows the streptavidin coated 96 well plate to associate with the biotinylated peptide. Wash the MTP module with 300 ul/well of PBS four times. Next add 75 ul of anti-phospotyrosine antibody conjugated to horse radish peroxidase (anti-P-Tyr-POD (0.5u/ml)) to each well and incubate at 37 degree C. for one hour. Wash the well as above.

Next add 100 ul of peroxidase substrate solution (Boehringer Mannheim) and incubate at room temperature for at least 5 mins (up to 30 min). Measure the absorbance of the sample at 405 nm by using ELISA reader. The level of bound peroxidase activity is quantitated using an ELISA reader and reflects the level of tyrosine kinase activity.

Example 39

High-Throughput Screening Assay Identifying Phosphorylation Activity

As a potential alternative and/or complement to the assay of protein tyrosine kinase activity described in Example 38, an assay which detects activation (phosphorylation) of major intracellular signal transduction intermediates can also be used. For example, as described below one particular assay can detect tyrosine phosphorylation of the Erk-1 and Erk-2 kinases. However, phosphorylation of other molecules, such as Raf, JNK, p38 MAP, Map kinase (MEK), MEK kinase, Src, Muscle specific kinase (MuSK), IRAK, Tec, and Janus, as well as any other phosphoserine, phosphotyrosine, or phosphothreonine molecule, can be detected by substituting these molecules for Erk-1 or Erk-2 in the following assay.

Specifically, assay plates are made by coating the wells of a 96-well ELISA plate with 0.1 ml of protein G (1 ug/ml) for 2 hr at room temp, (RT). The plates are then rinsed with PBS and blocked with 3% BSA/PBS for 1 hr at RT. The protein G plates are then treated with 2 commercial monoclonal antibodies (100 ng/well) against Erk-1 and Erk-2 (1 hr at RT) (Santa Cruz Biotechnology). (To detect other molecules, this step can easily be modified by substituting a monoclonal antibody detecting any of the above described molecules.) After 3-5 rinses with PBS, the plates are stored at 4 degree C. until use.

A431 cells are seeded at 20,000/well in a 96-well LOPRODYNE™ filter plate and cultured overnight in growth medium. The cells are then starved for 48 hr in basal medium (DMEM) and then treated with EGF (6 ng/well) or 50 ul of the supernatants obtained in Example 30 for 5-20 minutes. The cells are then solubilized and extracts filtered directly into the assay plate.

After incubation with the extract for 1 hr at RT, the wells are again rinsed. As a positive control, a commercial preparation of MAP kinase (10 ng/well) is used in place of A431 extract. Plates are then treated with a commercial polyclonal (rabbit) antibody (1 ug/ml) which specifically recognizes the phosphorylated epitope of the Erk-1 and Erk-2 kinases (1 hr at RT). This antibody is biotinylated by standard procedures. The bound polyclonal antibody is then quantitated by successive incubations with Europium-streptavidin and Europium fluorescence enhancing reagent in the Wallac DELFIA instrument (time-resolved fluorescence). An increased fluorescent signal over background indicates a phosphorylation by polypeptide of the present invention or a molecule induced by polypeptide of the present invention.

Example 40

Assay for the Stimulation of Bone Marrow CD34+ Cell Proliferation

This assay is based on the ability of human CD34+ to proliferate in the presence of hematopoietic growth factors and evaluates the ability of isolated polypeptides expressed in mammalian cells to stimulate proliferation of CD34+ cells.

It has been previously shown that most mature precursors will respond to only a single signal. More immature precursors require at least two signals to respond. Therefore, to test the effect of polypeptides on hematopoietic activity of a wide range of progenitor cells, the assay contains a given polypeptide in the presence or absence of other hematopoietic growth factors. Isolated cells are cultured for 5 days in the presence of Stem Cell Factor (SCF) in combination with tested sample. SCF alone has a very limited effect on the proliferation of bone marrow (BM) cells, acting in such conditions only as a "survival" factor. However, combined with any factor exhibiting stimulatory effect on these cells (e.g., IL-3), SCF will cause a synergistic effect. Therefore, if the tested polypeptide has a stimulatory effect on hematopoietic progenitors, such activity can be easily detected. Since normal BM cells have a low level of cycling cells, it is likely that any inhibitory effect of a given polypeptide, or agonists or antagonists thereof, might not be detected. Accordingly, assays for an inhibitory effect on progenitors is preferably tested in cells that are first subjected to in vitro stimulation with SCF+IL+3, and then contacted with the compound that is being evaluated for inhibition of such induced proliferation.

Briefly, CD34+ cells are isolated using methods known in the art. The cells are thawed and resuspended in medium (QBSF 60 serum-free medium with 1% L-glutamine (500 ml) Quality Biological, Inc., Gaithersburg, Md. Cat# 160-204-101). After several gentle centrifugation steps at 200×g, cells are allowed to rest for one hour. The cell count is adjusted to $2.5 \times 10^5$ cells/ml. During this time, 100 µl of sterile water is added to the peripheral wells of a 96-well plate. The cytokines that can be tested with a given polypeptide in this assay is rhSCF (R&D Systems, Minneapolis, Minn., Cat# 255-SC) at 50 ng/ml alone and in combination with rhSCF and rhIL-3 (R&D Systems, Minneapolis, Minn., Cat# 203-ML) at 30 ng/ml. After one hour, 10 µl of prepared cytokines, 50 µl of the supernatants prepared in Example 30 (supernatants at 1:2 dilution=50 µl) and 20 µl of diluted cells are added to the media which is already present in the wells to allow for a final total volume of 100 µl. The plates are then placed in a 37° C./5% $CO_2$ incubator for five days.

Eighteen hours before the assay is harvested, 0.5 µCi/well of [3H] Thymidine is added in a 10 µl volume to each well to determine the proliferation rate. The experiment is terminated by harvesting the cells from each 96-well plate to a filtermat using the Tomtec Harvester 96. After harvesting, the filtermats are dried, trimmed and placed into OMNIFILTER™ assemblies consisting of one OMNIFILTER™ plate and one OMNIFILTER™ Tray. 60 µl MICROSCINT™ is added to each well and the plate sealed with TopSeal-A press-on sealing film A bar code 15 sticker is affixed to the first plate for counting. The sealed plates are then loaded and the level of radioactivity determined via the Packard Top Count and the printed data collected for analysis. The level of radioactivity reflects the amount of cell proliferation.

The studies described in this example test the activity of a given polypeptide to stimulate bone marrow CD34+ cell proliferation. One skilled in the art could easily modify the exemplified studies to test the activity of polynucleotides (e.g., gene therapy), antibodies, agonists, and/or antagonists and fragments and variants thereof. As a nonlimiting example, potential antagonists tested in this assay would be expected to inhibit cell proliferation in the presence of cytokines and/or to increase the inhibition of cell proliferation in the presence of cytokines and a given polypeptide. In contrast, potential agonists tested in this assay would be expected to enhance cell proliferation and/or to decrease the inhibition of cell proliferation in the presence of cytokines and a given polypeptide.

The ability of a gene to stimulate the proliferation of bone marrow CD34+ cells indicates that polynucleotides and polypeptides corresponding to the gene are useful for the diagnosis and treatment of disorders affecting the immune system and hematopoiesis. Representative uses are described in the "Immune Activity" and "Infectious Disease" sections above, and elsewhere herein.

Example 41

Assay for Extracellular Matrix Enhanced Cell Response (EMECR)

The objective of the Extracellular Matrix Enhanced Cell Response (EMECR) assay is to identify gene products (e.g., isolated polypeptides) that act on the hematopoietic stem cells in the context of the extracellular matrix (ECM) induced signal.

Cells respond to the regulatory factors in the context of signal(s) received from the surrounding microenvironment. For example, fibroblasts, and endothelial and epithelial stem cells fail to replicate in the absence of signals from the ECM. Hematopoietic stem cells can undergo self-renewal in the bone marrow, but not in in vitro suspension culture. The ability of stem cells to undergo self-renewal in vitro is dependent upon their interaction with the stromal cells and the ECM protein fibronectin (fn). Adhesion of cells to fn is mediated by the $\alpha_5.\beta_1$ and $\alpha_4.\beta_1$ integrin receptors, which are expressed by human and mouse hematopoietic stem cells. The factor(s) which integrate with the ECM environment and are responsible for stimulating stem cell self-renewal have not yet been identified. Discovery of such factors should be of great interest in gene therapy and bone marrow transplant applications Briefly, polystyrene, non tissue culture treated, 96-well plates are coated with fn fragment at a coating concentration of 0.2 µg/cm². Mouse bone marrow cells are plated (1,000 cells/well) in 0.2 ml of serum-free medium. Cells cultured in the presence of IL-3 (5 ng/ml)+SCF (50 ng/ml) would serve as the positive control, conditions under which little self-renewal but pronounced differentiation of the stem cells is to be expected. Gene products of the invention (e.g., including, but not limited to, polynucleotides and polypeptides of the present invention, and supernatants produced in Example 30), are tested with appropriate negative controls in the presence and absence of SCF (5.0 ng/ml), where test factor supernatants represent 10% of the total assay volume. The plated cells are then allowed to grow by incubating in a low oxygen environment (5% $CO_2$, 7% $O_2$, and 88% $N_2$) tissue culture incubator for 7 days. The number of proliferating cells within the wells is then quantitated by measuring thymidine incorporation into cellular DNA. Verification of the positive hits in the assay will require phenotypic characterization of the cells, which can be accomplished by scaling up of the culture system and using appropriate antibody reagents against cell surface antigens and FACScan.

One skilled in the art could easily modify the exemplified studies to test the activity of polynucleotides (e.g., gene therapy), antibodies, agonists, and/or antagonists and fragments and variants thereof.

If a particular polypeptide of the present invention is found to be a stimulator of hematopoietic progenitors, polynucleotides and polypeptides corresponding to the gene encoding said polypeptide may be useful for the diagnosis and treatment of disorders affecting the immune system and hematopoiesis. Representative uses are described in the "Immune Activity" and "Infectious Disease" sections above, and elsewhere herein. The gene product may also be useful in the expansion of stem cells and committed progenitors of various blood lineages, and in the differentiation and/or proliferation of various cell types.

Additionally, the polynucleotides and/or polypeptides of the gene of interest and/or agonists and/or antagonists thereof, may also be employed to inhibit the proliferation and differentiation of hematopoietic cells and therefore may be employed to protect bone marrow stem cells from chemotherapeutic agents during chemotherapy. This antiproliferative effect may allow administration of higher doses of chemotherapeutic agents and, therefore, more effective chemotherapeutic treatment.

Moreover, polynucleotides and polypeptides corresponding to the gene of interest may also be useful for the treatment and diagnosis of hematopoietic related disorders such as, for example, anemia, pancytopenia, leukopenia, thrombocytopenia or leukemia since stromal cells are important in the production of cells of hematopoietic lineages. The uses include bone marrow cell ex-vivo culture, bone marrow transplantation, bone marrow reconstitution, radiotherapy or chemotherapy of neoplasia.

Example 42

Human Dermal Fibroblast and Aortic Smooth Muscle Cell Proliferation

The polypeptide of interest is added to cultures of normal human dermal fibroblasts (NHDF) and human aortic smooth muscle cells (AOSMC) and two co-assays are performed with each sample. The first assay examines the effect of the polypeptide of interest on the proliferation of normal human dermal fibroblasts (NHDF) or aortic smooth muscle cells (AoSMC). Aberrant growth of fibroblasts or smooth muscle cells is a part of several pathological processes, including fibrosis, and restenosis. The second assay examines IL6 production by both NHDF and SMC. IL6 production is an indication of functional activation. Activated cells will have increased production of a number of cytokines and other factors, which can result in a proinflammatory or immunomodulatory outcome. Assays are run with and without co-TNFa stimulation, in order to check for costimulatory or inhibitory activity.

Briefly, on day 1, 96-well black plates are set up with 1000 cells/well (NHDF) or 2000 cells/well (AoSMC) in 100 µl culture media NHDF culture media contains: Clonetics FB basal media, 1 mg/ml hFGF, 5 mg/ml insulin, 50 mg/ml gentamycin, 2% FBS, while AoSMC culture media contains Clonetics SM basal media, 0.5 µg/ml hEGF, 5 mg/ml insulin, 1 µg/ml hFGF, 50 mg/ml gentamycin, 50 µg/ml Amphotericin B, 5% FBS. After incubation at 37° C. for at least 4-5 hours culture media is aspirated and replaced with growth arrest media. Growth arrest media for NHDF contains fibroblast basal media, 50 mg/ml gentamycin, 2% FBS, while growth arrest media for AoSMC contains SM basal media, 50 mg/ml gentamycin, 50 µg/ml Amphotericin B, 0.4% FBS. Incubate at 37° C. until day 2.

On day 2, serial dilutions and templates of the polypeptide of interest are designed such that they always include media controls and known-protein controls. For both stimulation and inhibition experiments, proteins are diluted in growth arrest media. For inhibition experiments, TNFa is added to a final concentration of 2 ng/ml (NHDF) or 5 ng/ml (AoSMC). Add ⅓ vol media containing controls or polypeptides of the present invention and incubate at 37 degrees C./5% $CO_2$ until day 5.

Transfer 60 µl from each well to another labeled 96-well plate, cover with a plate-sealer, and store at 4 degrees C. until Day 6 (for IL6 ELISA). To the remaining 100 µl in the cell culture plate, aseptically add ALAMAR BLUE™ in an amount equal to 10% of the culture volume (10 μl). Return plates to incubator for 3 to 4 hours. Then measure fluorescence with excitation at 530 nm and emission at 590 nm using the CYTOFLUOR™. This yields the growth stimulation/inhibition data.

On day 5, the IL6 ELISA is performed by coating a 96 well plate with 50-100 ul/well of Anti-Human IL6 Monoclonal antibody diluted in PBS, pH 7.4, incubate ON at room temperature.

On day 6, empty the plates into the sink and blot on paper towels. Prepare Assay Buffer containing PBS with 4% BSA. Block the plates with 200 μl/well of Pierce Super Block blocking buffer in PBS for 1-2 hr and then wash plates with wash buffer (PBS, 0.05% Tween-20). Blot plates on paper towels. Then add 50 μl/well of diluted Anti-Human IL-6 Monoclonal, Biotin-labeled antibody at 0.50 mg/ml. Make dilutions of IL-6 stock in media (30, 10, 3, 1, 0.3, 0 ng/ml). Add duplicate samples to top row of plate. Cover the plates and incubate for 2 hours at RT on shaker.

Plates are washed with wash buffer and blotted on paper towels. Dilute EU-labeled Streptavidin 1:1000 in Assay buffer, and add 100 μl/well. Cover the plate and incubate 1 h at RT. Plates are again washed with wash buffer and blotted on paper towels.

Add 100 μl/well of Enhancement Solution. Shake for 5 minutes. Read the plate on the Wallac DELFIA Fluorometer. Readings from triplicate samples in each assay were tabulated and averaged.

A positive result in this assay suggests AoSMC cell proliferation and that the polypeptide of the present invention may be involved in dermal fibroblast proliferation and/or smooth muscle cell proliferation. A positive result also suggests many potential uses of polypeptides, polynucleotides, agonists and/or antagonists of the polynucleotide/polypeptide of the present invention which gives a positive result. For example, inflammation and immune responses, wound healing, and angiogenesis, as detailed throughout this specification. Particularly, polypeptides of the present invention and polynucleotides of the present invention may be used in wound healing and dermal regeneration, as well as the promotion of vasculogenesis, both of the blood vessels and lymphatics. The growth of vessels can be used in the treatment of, for example, cardiovascular diseases. Additionally, antagonists of polypeptides and polynucleotides of the invention may be useful in treating diseases, disorders, and/or conditions which involve angiogenesis by acting as an anti-vascular agent (e.g., anti-angiogenesis). These diseases, disorders, and/or conditions are known in the art and/or are described herein, such as, for example, malignancies, solid tumors, benign tumors, for example hemangiomas, acoustic neuromas, neurofibromas, trachomas, and pyogenic granulomas; artheroscleric plaques; ocular angiogenic diseases, for example, diabetic retinopathy, retinopathy of prematurity, macular degeneration, corneal graft rejection, neovascular glaucoma, retrolental fibroplasia, rubeosis, retinoblastoma, uvietis and Pterygia (abnormal blood vessel growth) of the eye; rheumatoid arthritis; psoriasis; delayed wound healing; endometriosis; vasculogenesis; granulations; hypertrophic scars (keloids); nonunion fractures; scleroderma; trachoma; vascular adhesions; myocardial angiogenesis; coronary collaterals; cerebral collaterals; arteriovenous malformations; ischemic limb angiogenesis; Osler-Webber Syndrome; plaque neovascularization; telangiectasia; hemophiliac joints; angiofibroma; fibromuscular dysplasia; wound granulation; Crohn's disease; and atherosclerosis. Moreover, antagonists of polypeptides and polynucleotides of the invention may be useful in treating anti-hyperproliferative diseases and/or anti-inflammatory known in the art and/or described herein.

One skilled in the art could easily modify the exemplified studies to test the activity of polynucleotides (e.g., gene therapy), antibodies, agonists, and/or antagonists and fragments and variants thereof.

Example 43

Cellular Adhesion Molecule (CAM) Expression on Endothelial Cells

The recruitment of lymphocytes to areas of inflammation and angiogenesis involves specific receptor-ligand interactions between cell surface adhesion molecules (CAMs) on lymphocytes and the vascular endothelium. The adhesion process, in both normal and pathological settings, follows a multi-step cascade that involves intercellular adhesion molecule-1 (ICAM-1), vascular cell adhesion molecule-1 (VCAM-1), and endothelial leukocyte adhesion molecule-1 (E-selectin) expression on endothelial cells (EC). The expression of these molecules and others on the vascular endothelium determines the efficiency with which leukocytes may adhere to the local vasculature and extravasate into the local tissue during the development of an inflammatory response. The local concentration of cytokines and growth factor participate in the modulation of the expression of these CAMs.

Briefly, endothelial cells (e.g., Human Umbilical Vein Endothelial cells (HUVECs)) are grown in a standard 96 well plate to confluence, growth medium is removed from the cells and replaced with 100 μl of 199 Medium (10% fetal bovine serum (FBS)). Samples for testing and positive or negative controls are added to the plate in triplicate (in 10 μl volumes). Plates are then incubated at 37° C. for either 5 h (selectin and integrin expression) or 24 h (integrin expression only). Plates are aspirated to remove medium and 100 μl of 0.1% paraformaldehyde-PBS (with Ca++ and Mg++) is added to each well. Plates are held at 4° C. for 30 min. Fixative is removed from the wells and wells are washed 1× with PBS(+Ca,Mg)+0.5% BSA and drained. 10 μl of diluted primary antibody is added to the test and control wells. Anti-ICAM-1-Biotin, Anti-VCAM-1-Biotin and Anti-E-selectin-Biotin are used at a concentration of 10 μg/ml (1:10 dilution of 0.1 mg/ml stock antibody). Cells are incubated at 37° C. for 30 min. in a humidified environment. Wells are washed three times with PBS(+Ca,Mg)+0.5% BSA. 20 μl of diluted EXTRAVIDIN™-Alkaline Phosphatase (1:5,000 dilution, referred to herein as the working dilution) are added to each well and incubated at 37° C. for 30 min. Wells are washed three times with PBS(+Ca,Mg)+0.5% BSA. Dissolve 1 tablet of p-Nitrophenol Phosphate pNPP per 5 ml of glycine buffer (pH 10.4). 100 μl of pNPP substrate in glycine buffer is added to each test well. Standard wells in triplicate are prepared from the working dilution of the EXTRAVIDIN™-Alkaline Phosphotase in glycine buffer: 1:5,000 ($10^0$)>$10^{-0.5}$>$10^{-1}$>$10^{-1.5}$. 5 μl of each dilution is added to triplicate wells and the resulting AP content in each well is 5.50 ng, 1.74 ng, 0.55 ng, 0.18 ng. 100 μl of pNNP reagent is then added to each of the standard wells. The plate is incubated at 37° C. for 4 h. A volume of 50 μl of 3M NaOH is added to all wells. The plate is read on a plate reader at 405 nm using the background subtraction option on blank wells filled with glycine buffer only. Additionally, the template is set up to indicate the concentration of AP-conjugate in each standard well [5.50 ng; 1.74 ng; 0.55 ng; 0.18 ng]. Results are indicated as amount of bound AP-conjugate in each sample.

Example 44

ALAMAR BLUE™ Endothelial Cells Proliferation Assay

This assay may be used to quantitatively determine protein mediated inhibition of bFGF-induced proliferation of Bovine Lymphatic Endothelial Cells (LECs), Bovine Aortic Endothelial Cells (BAECs) or Human Microvascular Uterine Myometrial Cells (UTMECs). This assay incorporates a fluorometric growth indicator based on detection of metabolic activity. A standard ALAMAR BLUE™ Proliferation Assay is prepared in EGM-2MV with 10 ng/ml of bFGF added as a source of endothelial cell stimulation. This assay may be used with a variety of endothelial cells with slight changes in growth medium and cell concentration. Dilutions of the protein batches to be tested are diluted as appropriate. Serum-free medium (GIBCO SFM) without bFGF is used as a non-stimulated control and Angiostatin or TSP-1 are included as a known inhibitory controls.

Briefly, LEC, BAECs or UTMECs are seeded in growth media at a density of 5000 to 2000 cells/well in a 96 well plate and placed at 37 degrees C. overnight. After the overnight incubation of the cells, the growth media is removed and replaced with GIBCO EC-SFM. The cells are treated with the appropriate dilutions of the protein of interest or control protein sample(s) (prepared in SFM) in triplicate wells with additional bFGF to a concentration of 10 ng/ml. Once the cells have been treated with the samples, the plate(s) is/are placed back in the 37° C. incubator for three days. After three days 10 ml of stock ALAMAR BLUE™ (Biosource Cat# DAL1100) is added to each well and the plate(s) is/are placed back in the 37° C. incubator for four hours. The plate(s) are then read at 530 nm excitation and 590 nm emission using the CYTOFLUOR™ fluorescence reader. Direct output is recorded in relative fluorescence units.

ALAMAR BLUE™ is an oxidation-reduction indicator that both fluoresces and changes color in response to chemical reduction of growth medium resulting from cell growth. As cells grow in culture, innate metabolic activity results in a chemical reduction of the immediate surrounding environment. Reduction related to growth causes the indicator to change from oxidized (non-fluorescent blue) form to reduced (fluorescent red) form (i.e., stimulated proliferation will produce a stronger signal and inhibited proliferation will produce a weaker signal and the total signal is proportional to the total number of cells as well as their metabolic activity). The background level of activity is observed with the starvation medium alone. This is compared to the output observed from the positive control samples (bFGF in growth medium) and protein dilutions.

Example 45

Detection of Inhibition of a Mixed Lymphocyte Reaction

This assay can be used to detect and evaluate inhibition of a Mixed Lymphocyte Reaction (MLR) by gene products (e.g., isolated polypeptides). Inhibition of a MLR may be due to a direct effect on cell proliferation and viability, modulation of costimulatory molecules on interacting cells, modulation of adhesiveness between lymphocytes and accessory cells, or modulation of cytokine production by accessory cells. Multiple cells may be targeted by these polypeptides since the peripheral blood mononuclear fraction used in this assay includes T, B and natural killer lymphocytes, as well as monocytes and dendritic cells.

Polypeptides of interest found to inhibit the MLR may find application in diseases associated with lymphocyte and monocyte activation or proliferation. These include, but are not limited to, diseases such as asthma, arthritis, diabetes, inflammatory skin conditions, psoriasis, eczema, systemic lupus erythematosus, multiple sclerosis, glomerulonephritis, inflammatory bowel disease, crohn's disease, ulcerative colitis, arteriosclerosis, cirrhosis, graft vs. host disease, host vs. graft disease, hepatitis, leukemia and lymphoma Briefly, PBMCs from human donors are purified by density gradient centrifugation using Lymphocyte Separation Medium (LSM®, density 1.0770 g/ml, Organon Teknika Corporation, West Chester, Pa.). PBMCs from two donors are adjusted to $2 \times 10^6$ cells/ml in RPMI-1640 (Life Technologies, Grand Island, N.Y.) supplemented with 10% FCS and 2 mM glutamine. PBMCs from a third donor is adjusted to $2 \times 10^5$ cells/ml. Fifty microliters of PBMCs from each donor is added to wells of a 96-well round bottom microtiter plate. Dilutions of test materials (50 µl) is added in triplicate to microtiter wells. Test samples (of the protein of interest) are added for final dilution of 1:4; rhuIL-2 (R&D Systems, Minneapolis, Minn., catalog number 202-IL) is added to a final concentration of 1 µg/ml; anti-CD4 mAb (R&D Systems, clone 34930.11, catalog number MAB379) is added to a final concentration of 10 µg/ml. Cells are cultured for 7-8 days at 37° C. in 5% $CO_2$, and 1 µC of [$^3$H] thymidine is added to wells for the last 16 hrs of culture. Cells are harvested and thymidine incorporation determined using a Packard Top-Count. Data is expressed as the mean and standard deviation of triplicate determinations.

Samples of the protein of interest are screened in separate experiments and compared to the negative control treatment, anti-CD4 mAb, which inhibits proliferation of lymphocytes and the positive control treatment, IL-2 (either as recombinant material or supernatant), which enhances proliferation of lymphocytes.

One skilled in the art could easily modify the exemplified studies to test the activity of polynucleotides (e.g., gene therapy), antibodies, agonists, and/or antagonists and fragments and variants thereof.

Example 46

Assays for Protease Activity

The following assay may be used to assess protease activity of the polypeptides of the invention.

Gelatin and casein zymography are performed essentially as described (Heusen et al., *Anal. Biochem.*, 102:196-202 (1980); Wilson et al., *Journal of Urology*, 149:653-658 (1993)). Samples are run on 10% polyacryamide/0.1% SDS gels containing 1% gelain orcasein, soaked in 2.5% triton at room temperature for 1 hour, and in 0.1M glycine, pH 8.3 at 37° C. 5 to 16 hours. After staining in amido black areas of proteolysis apear as clear areas agains the blue-black background. Trypsin (Sigma T8642) is used as a positive control.

Protease activity is also determined by monitoring the cleavage of n-a-benzoyl-L-arginine ethyl ester (BAEE) (Sigma B-4500. Reactions are set up in (25 mM $NaPO_4$, 1 mM EDTA, and 1 mM BAEE), pH 7.5. Samples are added and the change in adsorbance at 260 nm is monitored on the Beckman DU-6 spectrophotometer in the time-drive mode. Trypsin is used as a positive control.

Additional assays based upon the release of acid-soluble peptides from casein or hemoglobin measured as adsorbance at 280 nm or colorimetrically using the Folin method are performed as described in Bergmeyer, et al., *Methods of Enzymatic Analysis*, 5 (1984). Other assays involve the solubilization of chromogenic substrates (Ward, *Applied Science*, 251-317 (1983)).

Example 47

Identifying Serine Protease Substrate Specificity

Methods known in the art or described herein may be used to determine the substrate specificity of the polypeptides of the present invention having serine protease activity. A preferred method of determining substrate specificity is by the use of positional scanning synthetic combinatorial libraries as described in GB 2 324 529 (incorporated herein in its entirety).

Example 48

Ligand Binding Assays

The following assay may be used to assess ligand binding activity of the polypeptides of the invention.

Ligand binding assays provide a direct method for ascertaining receptor pharmacology and are adaptable to a high throughput format. The purified ligand for a polypeptide is radiolabeled to high specific activity (50-2000 Ci/mmol) for binding studies. A determination is then made that the process of radiolabeling does not diminish the activity of the ligand towards its polypeptide. Assay conditions for buffers, ions, pH and other modulators such as nucleotides are optimized to establish a workable signal to noise ratio for both membrane and whole cell polypeptide sources. For these assays, specific polypeptide binding is defined as total associated radioactivity minus the radioactivity measured in the presence of an excess of unlabeled competing ligand. Where possible, more than one competing ligand is used to define residual nonspecific binding.

Example 49

Functional Assay in *Xenopus* Oocytes

Capped RNA transcripts from linearized plasmid templates encoding the polypeptides of the invention are synthesized in vitro with RNA polymerases in accordance with standard procedures. In vitro transcripts are suspended in water at a final concentration of 0.2 mg/ml. Ovarian lobes are removed from adult female toads, Stage V defolliculated oocytes are obtained, and RNA transcripts (10 ng/oocyte) are injected in a 50 nl bolus using a microinjection apparatus. Two electrode voltage clamps are used to measure the currents from individual *Xenopus* oocytes in response polypeptides and polypeptide agonist exposure. Recordings are made in Ca2+ free Barth's medium at room temperature. The *Xenopus* system can be used to screen known ligands and tissue/cell extracts for activating ligands.

Example 50

Microphysiometric Assays

Activation of a wide variety of secondary messenger systems results in extrusion of small amounts of acid from a cell. The acid formed is largely as a result of the increased metabolic activity required to fuel the intracellular signaling process. The pH changes in the media surrounding the cell are very small but are detectable by the CYTOSENSOR microphysiometer (Molecular Devices Ltd., Menlo Park, Calif.). The CYTOSENSOR is thus capable of detecting the activation of polypeptide which is coupled to an energy utilizing intracellular signaling pathway.

Example 51

Extract/Cell Supernatant Screening

A large number of mammalian receptors exist for which there remains, as yet, no cognate activating ligand (agonist). Thus, active ligands for these receptors may not be included within the ligands banks as identified to date. Accordingly, the polypeptides of the invention can also be functionally screened (using calcium, cAMP, microphysiometer, oocyte electrophysiology, etc., functional screens) against tissue extracts to identify its natural ligands. Extracts that produce positive functional responses can be sequentially subfractionated until an activating ligand is isolated and identified.

Example 52

Calcium and cAMP Functional Assays

Seven transmembrane receptors which are expressed in HEK 293 cells have been shown to be coupled functionally to activation of PLC and calcium mobilization and/or cAMP stimulation or inhibition. Basal calcium levels in the HEK 293 cells in receptor-transfected or vector control cells were observed to be in the normal, 100 nM to 200 nM, range. HEK 293 cells expressing recombinant receptors are loaded with fura 2 and in a single day >150 selected ligands or tissue/cell extracts are evaluated for agonist induced calcium mobilization. Similarly, HEK 293 cells expressing recombinant receptors are evaluated for the stimulation or inhibition of cAMP production using standard cAMP quantitation assays. Agonists presenting a calcium transient or cAMP fluctuation are tested in vector control cells to determine if the response is unique to the transfected cells expressing receptor.

Example 53

ATP-Binding Assay

The following assay may be used to assess ATP-binding activity of polypeptides of the invention.

ATP-binding activity of the polypeptides of the invention may be detected using the ATP-binding assay described in U.S. Pat. No. 5,858,719, which is herein incorporated by reference in its entirety. Briefly, ATP-binding to polypeptides of the invention is measured via photoaffinity labeling with 8-azido-ATP in a competition assay. Reaction mixtures containing 1 mg/ml of the ABC transport protein of the present invention are incubated with varying concentrations of ATP, or the non-hydrolyzable ATP analog adenyl-5'-imidodiphosphate for 10 minutes at 4° C. A mixture of 8-azido-ATP (Sigma Chem. Corp., St. Louis, Mo.) plus 8-azido-ATP ($^{32}$P-ATP) (5 mCi/µmol, ICN, Irvine Calif.) is added to a final concentration of 100 µM and 0.5 ml aliquots are placed in the wells of a porcelain spot plate on ice. The plate is irradiated using a short wave 254 nm UV lamp at a distance of 2.5 cm from the plate for two one-minute intervals with a one-minute cooling interval in between. The reaction is stopped by addition of dithiothreitol to a final concentration of 2 mM. The incubations are subjected to SDS-PAGE electrophoresis, dried, and autoradiographed. Protein bands corresponding to the particular polypeptides of the invention are excised, and the radioactivity quantified. A decrease in radioactivity with increasing ATP or adenly-5'-imidodiphosphate provides a measure of ATP affinity to the polypeptides.

Example 54

Small Molecule Screening

This invention is particularly useful for screening therapeutic compounds by using the polypeptides of the invention, or binding fragments thereof, in any of a variety of drug screening techniques. The polypeptide or fragment employed in such a test may be affixed to a solid support, expressed on a cell surface, free in solution, or located intracellularly. One method of drug screening utilizes eukaryotic or prokaryotic host cells which are stably transformed with recombinant nucleic acids expressing the polypeptide or fragment. Drugs are screened against such transformed cells in competitive binding assays. One may measure, for example, the formulation of complexes between the agent being tested and polypeptide of the invention.

Thus, the present invention provides methods of screening for drugs or any other agents which affect activities mediated by the polypeptides of the invention. These methods comprise contacting such an agent with a polypeptide of the invention or fragment thereof and assaying for the presence of a complex between the agent and the polypeptide or fragment thereof, by methods well known in the art. In such a competitive binding assay, the agents to screen are typically labeled. Following incubation, free agent is separated from that present in bound form, and the amount of free or uncomplexed label is a measure of the ability of a particular agent to bind to the polypeptides of the invention.

Another technique for drug screening provides high throughput screening for compounds having suitable binding affinity to the polypeptides of the invention, and is described in great detail in European Patent Application 84/03564, published on Sep. 13, 1984, which is herein incorporated by reference in its entirety. Briefly stated, large numbers of different small molecule test compounds are synthesized on a solid substrate, such as plastic pins or some other surface. The test compounds are reacted with polypeptides of the invention and washed. Bound polypeptides are then detected by methods well known in the art. Purified polypeptides are coated directly onto plates for use in the aforementioned drug screening techniques. In addition, non-neutralizing antibodies may be used to capture the peptide and immobilize it on the solid support.

This invention also contemplates the use of competitive drug screening assays in which neutralizing antibodies capable of binding polypeptides of the invention specifically compete with a test compound for binding to the polypeptides or fragments thereof. In this manner, the antibodies are used to detect the presence of any peptide which shares one or more antigenic epitopes with a polypeptide of the invention.

Example 55

Phosphorylation Assay

In order to assay for phosphorylation activity of the polypeptides of the invention, a phosphorylation assay as described in U.S. Pat. No. 5,958,405 (which is herein incorporated by reference) is utilized. Briefly, phosphorylation activity may be measured by phosphorylation of a protein substrate using gamma-labeled $^{32}$P-ATP and quantitation of the incorporated radioactivity using a gamma radioisotope counter. The polypeptides of the invention are incubated with the protein substrate, $^{32}$P-ATP, and a kinase buffer. The $^{32}$P incorporated into the substrate is then separated from free $^{32}$P-ATP by electrophoresis, and the incorporated $^{32}$P is counted and compared to a negative control. Radioactivity counts above the negative control are indicative of phosphorylation activity of the polypeptides of the invention.

Example 56

Detection of Phosphorylation Activity (Activation) of the Polypeptides of the Invention in the Presence of Polypeptide Ligands Methods known in the art or described herein may be used to determine the phosphorylation activity of the polypeptides of the invention. A preferred method of determining phosphorylation activity is by the use of the tyrosine phosphorylation assay as described in U.S. Pat. No. 5,817,471 (incorporated herein by reference).

Example 57

Identification of Signal Transduction Proteins that Interact with Polypeptides of the Present Invention The purified polypeptides of the invention are research tools for the identification, characterization and purification of additional signal transduction pathway proteins or receptor proteins. Briefly, labeled polypeptides of the invention are useful as reagents for the purification of molecules with which it interacts. In one embodiment of affinity purification, polypeptides of the invention are covalently coupled to a chromatography column. Cell-free extract derived from putative target cells, such as carcinoma tissues, is passed over the column, and molecules with appropriate affinity bind to the polypeptides of the invention. The protein complex is recovered from the column, dissociated, and the recovered molecule subjected to N-terminal protein sequencing. This amino acid sequence is then used to identify the captured molecule or to design degenerate oligonucleotide probes for cloning the relevant gene from an appropriate cDNA library.

Example 58

IL-6 Bioassay

To test the proliferative effects of the polypeptides of the invention, the IL-6 Bioassay as described by Marz et al. is utilized (*Proc. Natl. Acad. Sci., U.S.A.*, 95:3251-56 (1998), which is herein incorporated by reference). Briefly, IL-6 dependent B9 murine cells are washed three times in IL-6 free medium and plated at a concentration of 5,000 cells per well in 50 µl, and 50 µl of the IL-6-like polypeptide is added. After 68 hrs. at 37° C., the number of viable cells is measured by adding the tetrazolium salt thiazolyl blue (MTT) and incubating for a further 4 hrs. at 37° C. B9 cells are lysed by SDS and optical density is measured at 570 nm. Controls containing IL-6 (positive) and no cytokine (negative) are utilized. Enhanced proliferation in the test sample(s) relative to the negative control is indicative of proliferative effects mediated by polypeptides of the invention.

Example 59

Support of Chicken Embryo Neuron Survival

To test whether sympathetic neuronal cell viability is supported by polypeptides of the invention, the chicken embryo neuronal survival assay of Senaldi et al is utilized (*Proc. Natl. Acad. Sci., U.S.A.*, 96:11458-63 (1998), which is herein incorporated by reference). Briefly, motor and sympathetic neurons are isolated from chicken embryos, resuspended in L15 medium (with 10% FCS, glucose, sodium selenite, progesterone, conalbumin, putrescine, and insulin; Life Technologies, Rockville, Md.) and Dulbecco's modified Eagles medium [with 10% FCS, glutamine, penicillin, and 25 mM Hepes buffer (pH 7.2); Life Technologies, Rockville, Md.], respectively, and incubated at 37° C. in 5% $CO_2$ in the presence of different concentrations of the purified IL-6-like polypeptide, as well as a negative control lacking any cytokine. After 3 days, neuron survival is determined by evaluation of cellular morphology, and through the use of the colorimetric assay of Mosmann (Mosmann, T., *J. Immunol. Methods*, 65:55-63 (1983)). Enhanced neuronal cell viability as compared to the controls lacking cytokine is indicative of the ability of the inventive purified IL-6-like polypeptide(s) to enhance the survival of neuronal cells.

Example 60

Assay for Phosphatase Activity

The following assay may be used to assess serine/threonine phosphatase (PTPase) activity of the polypeptides of the invention.

In order to assay for serine/threonine phosphatase (PTPase) activity, assays can be utilized which are widely known to those skilled in the art. For example, the serine/threonine phosphatase (PSPase) activity is measured using a PSPase assay kit from New England Biolabs, Inc. Myelin basic protein (MyBP), a substrate for PSPase, is phosphorylated on serine and threonine residues with cAMP-dependent Protein Kinase in the presence of [$^{32}$P]ATP. Protein serine/threonine phosphatase activity is then determined by measuring the release of inorganic phosphate from $^{32}$P-labeled MyBP.

Example 61

Interaction of Serine/Threonine Phosphatases with other Proteins

The polypeptides of the invention with serine/threonine phosphatase activity as determined in Example 60 are research tools for the identification, characterization and purification of additional interacting proteins or receptor proteins, or other signal transduction pathway proteins. Briefly, labeled polypeptide(s) of the invention is useful as a reagent for the purification of molecules with which it interacts. In one embodiment of affinity purification, polypeptide of the invention is covalently coupled to a chromatography column. Cell-free extract derived from putative target cells, such as neural or liver cells, is passed over the column, and molecules with appropriate affinity bind to the polypeptides of the invention. The polypeptides of the invention—complex is recovered from the column, dissociated, and the recovered molecule subjected to N-terminal protein sequencing. This amino acid sequence is then used to identify the captured molecule or to design degenerate oligonucleotide probes for cloning the relevant gene from an appropriate cDNA library.

Example 62

Assaying for Heparanase Activity

In order to assay for heparanase activity of the polypeptides of the invention, the heparanase assay described by Vlodavsky et al is utilized (Vlodavsky, I., et al., Nat. Med., 5:793-802 (1999)). Briefly, cell lysates, conditioned media or intact cells ($1 \times 10^6$ cells per 35-mm dish) are incubated for 18 hrs at 37° C., pH 6.2-6.6, with $^{35}$S-labeled ECM or soluble ECM derived peak I proteoglycans. The incubation medium is centrifuged and the supernatant is analyzed by gel filtration on a Sepharose CL-6B column (0.9×30 cm). Fractions are eluted with PBS and their radioactivity is measured. Degradation fragments of heparan sulfate side chains are eluted from Sepharose 6B at $0.5 < K_{av} < 0.8$ (peak II). Each experiment is done at least three times. Degradation fragments corresponding to "peak II," as described by Vlodavsky et al., is indicative of the activity of the polypeptides of the invention in cleaving heparan sulfate.

Example 63

Immobilization of Biomolecules

This example provides a method for the stabilization of polypeptides of the invention in non-host cell lipid bilayer constructs (see, e.g., Bieri et al., Nature Biotech 17:1105-1108 (1999), hereby incorporated by reference in its entirety herein) which can be adapted for the study of polypeptides of the invention in the various functional assays described above. Briefly, carbohydrate-specific chemistry for biotinylation is used to confine a biotin tag to the extracellular domain of the polypeptides of the invention, thus allowing uniform orientation upon immobilization. A 50 uM solution of polypeptides of the invention in washed membranes is incubated with 20 mM NaIO4 and 1.5 mg/ml (4 mM) BACH or 2 mg/ml (7.5 mM) biotin-hydrazide for 1 hr at room temperature (reaction volume, 150 ul). Then the sample is dialyzed (Pierce Slidealizer Cassett, 10 kDa cutoff; Pierce Chemical Co., Rockford Ill.) at 4 C first for 5 h, exchanging the buffer after each hour, and finally for 12 h against 500 ml buffer R (0.15 M NaCl, 1 mM MgCl2, 10 mM sodium phosphate, pH7). Just before addition into a cuvette, the sample is diluted 1:5 in buffer ROG50 (Buffer R supplemented with 50 mM octylglucoside).

Example 64

TAQMAN®

Quantitative PCR (QPCR). Total RNA from cells in culture are extracted by Trizol separation as recommended by the supplier (LifeTechnologies). (Total RNA is treated with DNase I (Life Technologies) to remove any contaminating genomic DNA before reverse transcription.) Total RNA (50 ng) is used in a one-step, 50 ul, RT-QPCR, consisting of TAQMAN® Buffer A (Perkin-Elmer; 50 mM KCl/10 mM Tris, pH 8.3), 5.5 mM $MgCl_2$, 240 µM each dNTP, 0.4 units RNase inhibitor (Promega), 8% glycerol, 0.012% Tween-20, 0.05% gelatin, 0.3 uM primers, 0.1 uM probe, 0.025 units AMPLITAQ GOLD® (Perkin-Elmer) and 2.5 units Superscript II reverse transcriptase (Life Technologies). As a control for genomic contamination, parallel reactions are setup without reverse transcriptase. The relative abundance of (unknown) and 18S RNAs are assessed by using the Applied Biosystems Prism 7700 Sequence Detection System (Livak, K. J., Flood, S. J., Marmaro, J., Giusti, W. & Deetz, K. (1995) PCR Methods Appl. 4, 357-362). Reactions are carried out at 48° C. for 30 min, 95° C. for 10 min, followed by 40 cycles of 95° C. for 15 s, 60° C. for 1 min. Reactions are performed in triplicate.

Primers (f & r) and FRET probes sets are designed using Primer Express Software (Perkin-Elmer). Probes are labeled at the 5'-end with the reporter dye 6-FAM and on the 3'-end with the quencher dye TAMRA (Biosource International, Camarillo, Calif. or Perkin-Elmer).

Example 65

Assays for Metalloproteinase Activity

Metalloproteinases (EC 3.4.24.-) are peptide hydrolases which use metal ions, such as $Zn^{2+}$, as the catalytic mechanism. Metalloproteinase activity of polypeptides of the present invention can be assayed according to the following methods.

Proteolysis of Alpha-2-Macroglobulin

To confirm protease activity, purified polypeptides of the invention are mixed with the substrate alpha-2-macroglobulin (0.2 unit/ml; Boehringer Mannheim, Germany) in 1× assay buffer (50 mM HEPES, pH 7.5, 0.2 M NaCl, 10 mM $CaCl_2$, 25 µM $ZnCl_2$ and 0.05% Brij-35) and incubated at 37° C. for 1-5 days. Trypsin is used as positive control. Negative controls contain only alpha-2-macroglobulin in assay buffer. The samples are collected and boiled in SDS-PAGE sample buffer containing 5% 2-mercaptoethanol for 5-min, then loaded onto 8% SDS-polyacrylamide gel. After electrophoresis the proteins are visualized by silver staining. Proteolysis is evident by the appearance of lower molecular weight bands as compared to the negative control.

Inhibition of Alpha-2-Macroglobulin Proteolysis by Inhibitors of Metalloproteinases Known metalloproteinase inhibitors (metal chelators (EDTA, EGTA, AND $HgCl_2$), peptide metalloproteinase inhibitors (TIMP-1 and TIMP-2), and commercial small molecule MMP inhibitors) are used to characterize the proteolytic activity of polypeptides of the invention. The three synthetic MMP inhibitors used are: MMP inhibitor I, [$IC_{50}$=1.0 µM against MMP-1 and MMP-8; $IC_{50}$=30 µM against MMP-9; $IC_{50}$=150 µM against MMP-3]; MMP-3 (stromelysin-1) inhibitor I [$IC_{50}$=5 µM against MMP-3], and MMP-3 inhibitor II [$K_i$=130 nM against MMP-3]; inhibitors available through Calbiochem, catalog # 444250, 444218, and 444225, respectively). Briefly, different concentrations of the small molecule MMP inhibitors are mixed with purified polypeptides of the invention (50 µg/ml) in 22.9 µl of 1×HEPES buffer (50 mM HEPES, pH 7.5, 0.2 M NaCl, 10 mM $CaCl_2$, 25 µM $ZnCl_2$ and 0.05% Brij-35) and incubated at room temperature (24° C.) for 2-hr, then 7.1 µl of substrate alpha-2-macroglobulin (0.2 unit/ml) is added and incubated at 37° C. for 20-hr. The reactions are stopped by adding 4× sample buffer and boiled immediately for 5 minutes. After SDS-PAGE, the protein bands are visualized by silver stain.

Synthetic Fluorogenic Peptide Substrates Cleavage Assay

The substrate specificity for polypeptides of the invention with demonstrated metalloproteinase activity can be determined using synthetic fluorogenic peptide substrates (purchased from BACHEM Bioscience Inc). Test substrates include, M-1985, M-2225, M-2105, M-2110, and M-2255. The first four are MMP substrates and the last one is a substrate of tumor necrosis factor-α (TNF-α) converting enzyme (TACE). All the substrates are prepared in 1:1 dimethyl sulfoxide (DMSO) and water. The stock solutions are 50-500 µM. Fluorescent assays are performed by using a Perkin Elmer LS 50B luminescence spectrometer equipped with a constant temperature water bath. The excitation X is 328 nm and the emission X is 393 nm. Briefly, the assay is carried out by incubating 176 µl 1×HEPES buffer (0.2 M NaCl, 10 mM $CaCl_2$, 0.05% Brij-35 and 50 mM HEPES, pH 7.5) with 4 µl of substrate solution (50 µM) at 25° C. for 15 minutes, and then adding 20 µl of a purified polypeptide of the invention into the assay cuvette. The final concentration of substrate is 1 µM. Initial hydrolysis rates are monitored for 30-min.

Example 66

Characterization of the cDNA Contained in a Deposited Plasmid

The size of the cDNA insert contained in a deposited plasmid may be routinely determined using techniques known in the art, such as PCR amplification using synthetic primers hybridizable to the 3' and 5' ends of the cDNA sequence. For example, two primers of 17-30 nucleotides derived from each end of the cDNA (i.e., hybridizable to the absolute 5' nucleotide or the 3' nucleotide end of the sequence of SEQ ID NO:X, respectively) are synthesized and used to amplify the cDNA using the deposited cDNA plasmid as a template. The polymerase chain reaction is carried out under routine conditions, for instance, in 25 ul of reaction mixture with 0.5 ug of the above cDNA template. A convenient reaction mixture is 1.5-5 mM $MgCl_2$, 0.01% (w/v) gelatin, 20 uM each of dATP, dCTP, dGTP, dTTP, 25 pmol of each primer and 0.25 Unit of Taq polymerase. Thirty five cycles of PCR (denaturation at 94 degree C. for 1 min; annealing at 55 degree C. for 1 min; elongation at 72 degree C. for 1 min) are performed with a Perkin-Elmer Cetus automated thermal cycler. The amplified product is analyzed by agarose gel electrophoresis. The PCR product is verified to be the selected sequence by subcloning and sequencing the DNA product. It will be clear that the invention may be practiced otherwise than as particularly described in the foregoing description and examples. Numerous modifications and variations of the present invention are possible in light of the above teachings and, therefore, are within the scope of the appended claims.

INCORPORATION BY REFERENCE

The entire disclosure of each document cited (including patents, patent applications, journal articles, abstracts, laboratory manuals, books, or other disclosures) in the Background of the Invention, Detailed Description, and Examples is hereby incorporated herein by reference. In addition, the sequence listing submitted herewith is incorporated herein by reference in its entirety. The specification and sequence listing of each of the following U.S. and PCT applications are herein incorporated by reference in their entirety: U.S. Appln. No. 60/277,340 filed on Mar. 21, 2001, U.S. Appln. No. 60/306,171 filed on Jul. 19, 2001, U.S. Appln. No. 60/278,650 filed on Mar. 27, 2001, U.S. Appln. No. 60/331,287 filed on Nov. 13, 2001, U.S. application Ser. No. 09/950,082 filed on Sep. 12, 2001, U.S. application Ser. No. 09/950,083 filed on Sep. 12, 2001, U.S. Appln. No. 60/040,162 filed on Mar. 7, 1997, U.S. Appln. No. 60/043,576 filed on Apr. 11, 1997, U.S. Appln. No. 60/047,601 filed on May 23, 1997, U.S. Appln. No. 60/056,845 filed on Aug. 22, 1997, U.S. Appln. No. 60/043,580 filed on Apr. 11, 1997, U.S. Appln. No. 60/047,599 filed on May 23, 1997, U.S. Appln. No. 60/056,664 filed on Aug. 22, 1997, U.S. Appln. No. 60/043,314 filed on Apr. 11, 1997, U.S. Appln. No. 60/047,632 filed on May 23, 1997, U.S. Appln. No. 60/056,892 filed on Aug. 22, 1997, U.S. Appln. No. 60/043,568 filed on Apr. 11, 1997, U.S. Appln. No. 60/047,595 filed on May 23, 1997, U.S. Appln. No. 60/056,632 filed on Aug. 22, 1997, U.S. Appln. No. 60/043,578 filed on Apr. 11, 1997, U.S. Appln. No. 60/040,333 filed on Mar. 7, 1997, U.S. Appln. No. 60/043,670 filed on Apr. 11, 1997, U.S. Appln. No. 60/047,596 filed on May 23, 1997, U.S. Appln. No. 60/056,864 filed on Aug. 22, 1997, U.S. Appln. No. 60/043,674 filed on Apr. 11, 1997, U.S. Appln. No. 60/047,612 filed on May 23, 1997, U.S. Appln. No. 60/056,631 filed on Aug. 22, 1997, U.S. Appln. No. 60/043,569 filed on Apr. 11, 1997, U.S. Appln. No. 60/047,588 filed on May 23, 1997, U.S. Appln. No. 60/056,876 filed on Aug. 22, 1997, U.S. Appln. No. 60/043,671 filed on Apr. 11, 1997, U.S. Appln. No. 60/043,311 filed on Apr. 11, 1997, U.S. Appln. No. 60/038,621 filed on Mar. 7, 1997, U.S. Appln. No. 60/043,672 filed on Apr. 11, 1997, U.S. Appln. No. 60/047,613 filed on May 23, 1997, U.S. Appln. No. 60/056,636 filed on Aug. 22, 1997, U.S. Appln. No. 60/043,669 filed on Apr. 11, 1997, U.S. Appln. No. 60/047,582 filed on May 23, 1997, U.S. Appln. No. 60/056,910 filed on Aug. 22, 1997, U.S. Appln. No. 60/043,315 filed on Apr. 11, 1997, U.S. Appln. No. 60/047,598 filed on May 23, 1997, U.S. Appln. No. 60/056,874 filed on Aug. 22, 1997, U.S. Appln. No. 60/043,312 filed on Apr. 11, 1997, U.S. Appln. No. 60/047,585 filed on May 23, 1997, U.S. Appln. No. 60/056,881 filed on Aug. 22, 1997, U.S. Appln. No. 60/043,313 filed on Apr. 11, 1997, U.S. Appln. No. 60/047,586 filed on May 23, 1997, U.S. Appln. No. 60/056,909 filed on Aug. 22, 1997, U.S. Appln. No. 60/040,161 filed on Mar. 7, 1997, U.S. Appln. No. 60/047,587 filed on May 23, 1997, U.S. Appln. No. 60/056,879 filed on Aug. 22, 1997, U.S. Appln. No. 60/047,500 filed on May 23, 1997, U.S. Appln. No. 60/056,880 filed on Aug. 22, 1997, U.S. Appln. No. 60/047,584 filed on May 23, 1997, U.S. Appln. No. 60/056,894 filed on Aug. 22, 1997, U.S. Appln. No. 60/047,492 filed on May 23, 1997, U.S. Appln. No. 60/056,911 filed on Aug. 22, 1997, U.S. Appln. No. 60/040,626 filed on Mar. 7, 1997, U.S. Appln. No. 60/047,503 filed on May 23, 1997, U.S. Appln. No. 60/056,903 filed on Aug. 22, 1997, U.S. Appln. No. 60/047,501 filed on May 23, 1997, U.S. Appln. No. 60/056,637 filed on Aug. 22, 1997, U.S. Appln. No. 60/047,590 filed on May 23, 1997, U.S. Appln. No. 60/056,875 filed on Aug. 22, 1997, U.S. Appln. No. 60/047,581 filed on May 23, 1997, U.S. Appln. No. 60/056,882 filed on Aug. 22, 1997, U.S. Appln. No. 60/047,592 filed on May 23, 1997, U.S. Appln. No. 60/056,888 filed on Aug. 22, 1997, U.S. Appln. No. 60/040,334 filed on Mar. 7, 1997, U.S. Appln. No. 60/047,618 filed on May 23, 1997, U.S. Appln. No. 60/056,872 filed on Aug. 22, 1997, U.S. Appln. No. 60/047,617 filed on May 23, 1997, U.S. Appln. No. 60/056,662 filed on Aug. 22, 1997, U.S. Appln. No. 60/047,589 filed on May 23, 1997, U.S. Appln. No. 60/056,862 filed on Aug. 22, 1997, U.S. Appln. No. 60/047,594 filed on May 23, 1997, U.S. Appln. No. 60/056,884 filed on Aug. 22, 1997, U.S. Appln. No. 60/047,583 filed on May 23, 1997, U.S. Appln. No. 60/056,878 filed on Aug. 22, 1997, U.S. Appln. No. 60/040,336 filed on Mar. 7, 1997, U.S. Appln. No. 60/047,502 filed on May 23, 1997, U.S. Appln. No. 60/056,893 filed on Aug. 22, 1997, U.S. Appln. No. 60/047,633 filed on May 23, 1997, U.S. Appln. No. 60/056,630 filed on Aug. 22, 1997, U.S. Appln. No. 60/047,593 filed on May 23, 1997, U.S. Appln. No. 60/056,887 filed on Aug. 22, 1997, U.S. Appln. No. 60/040,163 filed on Mar. 7, 1997, U.S. Appln. No. 60/047,597 filed on May 23, 1997, U.S. Appln. No. 60/056,889 filed on Aug. 22, 1997, U.S. Appln. No. 60/047,615 filed on May 23, 1997, U.S. Appln. No. 60/056,877 filed on Aug. 22, 1997, U.S. Appln. No. 60/047,600 filed on May 23, 1997, U.S. Appln. No. 60/056,886 filed on Aug. 22, 1997, U.S. Appln. No. 60/047,614 filed on May 23, 1997, U.S. Appln. No. 60/056,908 filed on Aug. 22, 1997, U.S. Appln. No. 60/040,710 filed on Mar. 14, 1997, U.S. Appln. No. 60/050,934 filed on May 30, 1997, U.S. Appln. No. 60/048,100 filed on May 30, 1997, U.S. Appln. No. 60/040,762 filed on Mar. 14, 1997, U.S. Appln. No. 60/048,357 filed on May 30, 1997, U.S. Appln. No. 60/048,189 filed on May 30, 1997, U.S. Appln. No. 60/041,277 filed on Mar. 21, 1997, U.S. Appln. No. 60/048,188 filed on May 30, 1997, U.S. Appln. No. 60/048,094 filed on May 30, 1997, U.S. Appln. No. 60/048,350 filed on May 30, 1997, U.S. Appln. No. 60/048,135 filed on May 30, 1997, U.S. Appln. No. 60/042,344 filed on Mar. 21, 1997, U.S. Appln. No. 60/048,187 filed on May 30, 1997, U.S. Appln. No. 60/048,099 filed on May 30, 1997, U.S. Appln. No. 60/050,937 filed on May 30, 1997, U.S. Appln. No. 60/048,352 filed on May 30, 1997, U.S. Appln. No. 60/041,276 filed on Mar. 21, 1997, U.S. Appln. No. 60/048,069 filed on May 30, 1997, U.S. Appln. No. 60/048,131 filed on May 30, 1997, U.S. Appln. No. 60/048,186 filed on May 30, 1997, U.S. Appln. No. 60/048,095 filed on May 30, 1997, U.S. Appln. No. 60/041,281 filed on Mar. 21, 1997, U.S. Appln. No. 60/048,355 filed on May 30, 1997, U.S. Appln. No. 60/048,096 filed on May 30, 1997, U.S. Appln. No. 60/048,351 filed on May 30, 1997, U.S. Appln. No. 60/048,154 filed on May 30, 1997, U.S. Appln. No. 60/048,160 filed on May 30, 1997, U.S. Appln. No. 60/042,825 filed on Apr. 8, 1997, U.S. Appln. No. 60/048,070 filed on May 30, 1997, U.S. Appln. No. 60/042,727 filed on Apr. 8, 1997, U.S. Appln. No. 60/048,068 filed on May 30, 1997, U.S. Appln. No. 60/042,726 filed on Apr. 8, 1997, U.S. Appln. No. 60/048,184 filed on May 30, 1997, U.S. Appln. No. 60/042,728 filed on Apr. 8, 1997, U.S. Appln. No. 60/042,754 filed on Apr. 8, 1997, U.S. Appln. No. 60/048,190 filed on May 30, 1997, U.S. Appln. No. 60/044,039 filed on May 30, 1997, U.S. Appln. No. 60/048,093 filed on May 30, 1997, U.S. Appln. No. 60/048,885 filed on Jun. 6, 1997, U.S. Appln. No. 60/057,645 filed on Sep. 5, 1997, U.S. Appln. No. 60/049,375 filed on Jun. 6, 1997, U.S. Appln. No. 60/057,642 filed on Sep. 5, 1997, U.S. Appln. No. 60/048,881 filed on Jun. 6, 1997, U.S. Appln. No. 60/057,668 filed on Sep. 5, 1997, U.S. Appln. No. 60/048,880 filed on Jun. 6, 1997, U.S. Appln. No. 60/057,635 filed on Sep. 5, 1997, U.S. Appln. No. 60/048,896 filed on Jun. 6, 1997, U.S. Appln. No. 60/057,627 filed on Sep. 5, 1997, U.S. Appln. No. 60/049,020 filed on Jun. 6, 1997, U.S. Appln. No. 60/057,667 filed on Sep. 5, 1997, U.S. Appln. No. 60/048,876 filed on Jun. 6, 1997, U.S. Appln. No. 60/057,666 filed on Sep. 5, 1997, U.S. Appln. No. 60/048,895 filed on Jun. 6, 1997, U.S. Appln. No. 60/057,764 filed on Sep. 5, 1997, U.S. Appln. No. 60/048,884 filed on Jun. 6, 1997, U.S. Appln. No. 60/057,643 filed on Sep. 5, 1997, U.S. Appln. No. 60/048,894 filed on Jun. 6, 1997, U.S. Appln. No. 60/057,769 filed on Sep. 5, 1997, U.S. Appln. No. 60/048,971 filed on Jun. 6, 1997, U.S. Appln. No. 60/057,763 filed on Sep. 5, 1997, U.S. Appln. No. 60/048,964 filed on Jun. 6, 1997, U.S. Appln. No. 60/057,650 filed on Sep. 5, 1997, U.S. Appln. No. 60/048,882 filed on Jun. 6, 1997, U.S. Appln. No. 60/057,584 filed on Sep. 5, 1997, U.S. Appln. No. 60/048,899 filed on Jun. 6, 1997, U.S. Appln. No. 60/057,647 filed on Sep. 5, 1997, U.S. Appln. No. 60/048,893 filed on Jun. 6, 1997, U.S. Appln. No. 60/057,661 filed on Sep. 5, 1997, U.S. Appln. No. 60/048,900 filed on Jun. 6, 1997, U.S. Appln. No. 60/057,662 filed on Sep. 5, 1997, U.S. Appln. No. 60/048,901 filed on Jun. 6, 1997, U.S. Appln. No. 60/057,646 filed on Sep. 5, 1997, U.S. Appln. No. 60/048,892 filed on Jun. 6, 1997, U.S.

Appln. No. 60/057,654 filed on Sep. 5, 1997, U.S. Appln. No. 60/048,915 filed on Jun. 6, 1997, U.S. Appln. No. 60/057,651 filed on Sep. 5, 1997, U.S. Appln. No. 60/049,019 filed on Jun. 6, 1997, U.S. Appln. No. 60/057,644 filed on Sep. 5, 1997, U.S. Appln. No. 60/048,970 filed on Jun. 6, 1997, U.S. Appln. No. 60/057,765 filed on Sep. 5, 1997, U.S. Appln. No. 60/048,972 filed on Jun. 6, 1997, U.S. Appln. No. 60/057,762 filed on Sep. 5, 1997, U.S. Appln. No. 60/048,916 filed on Jun. 6, 1997, U.S. Appln. No. 60/057,775 filed on Sep. 5, 1997, U.S. Appln. No. 60/049,373 filed on Jun. 6, 1997, U.S. Appln. No. 60/057,648 filed on Sep. 5, 1997, U.S. Appln. No. 60/048,875 filed on Jun. 6, 1997, U.S. Appln. No. 60/057,774 filed on Sep. 5, 1997, U.S. Appln. No. 60/049,374 filed on Jun. 6, 1997, U.S. Appln. No. 60/057,649 filed on Sep. 5, 1997, U.S. Appln. No. 60/048,917 filed on Jun. 6, 1997, U.S. Appln. No. 60/057,770 filed on Sep. 5, 1997, U.S. Appln. No. 60/048,949 filed on Jun. 6, 1997, U.S. Appln. No. 60/057,771 filed on Sep. 5, 1997, U.S. Appln. No. 60/048,974 filed on Jun. 6, 1997, U.S. Appln. No. 60/057,761 filed on Sep. 5, 1997, U.S. Appln. No. 60/048,883 filed on Jun. 6, 1997, U.S. Appln. No. 60/057,760 filed on Sep. 5, 1997, U.S. Appln. No. 60/048,897 filed on Jun. 6, 1997, U.S. Appln. No. 60/057,776 filed on Sep. 5, 1997, U.S. Appln. No. 60/048,898 filed on Jun. 6, 1997, U.S. Appln. No. 60/057,778 filed on Sep. 5, 1997, U.S. Appln. No. 60/048,962 filed on Jun. 6, 1997, U.S. Appln. No. 60/057,629 filed on Sep. 5, 1997, U.S. Appln. No. 60/048,963 filed on Jun. 6, 1997, U.S. Appln. No. 60/057,628 filed on Sep. 5, 1997, U.S. Appln. No. 60/048,877 filed on Jun. 6, 1997, U.S. Appln. No. 60/057,777 filed on Sep. 5, 1997, U.S. Appln. No. 60/048,878 filed on Jun. 6, 1997, U.S. Appln. No. 60/057,634 filed on Sep. 5, 1997, U.S. Appln. No. 60/049,608 filed on Jun. 13, 1997, U.S. Appln. No. 60/058,669 filed on Sep. 12, 1997, U.S. Appln. No. 60/049,566 filed on Jun. 13, 1997, U.S. Appln. No. 60/058,668 filed on Sep. 12, 1997, U.S. Appln. No. 60/052,989 filed on Jun. 13, 1997, U.S. Appln. No. 60/058,750 filed on Sep. 12, 1997, U.S. Appln. No. 60/049,607 filed on Jun. 13, 1997, U.S. Appln. No. 60/058,665 filed on Sep. 12, 1997, U.S. Appln. No. 60/049,611 filed on Jun. 13, 1997, U.S. Appln. No. 60/058,971 filed on Sep. 12, 1997, U.S. Appln. No. 60/050,901 filed on Jun. 13, 1997, U.S. Appln. No. 60/058,972 filed on Sep. 12, 1997, U.S. Appln. No. 60/049,609 filed on Jun. 13, 1997, U.S. Appln. No. 60/058,975 filed on Sep. 12, 1997, U.S. Appln. No. 60/048,356 filed on May 30, 1997, U.S. Appln. No. 60/056,296 filed on Aug. 29, 1997, U.S. Appln. No. 60/048,101 filed on May 30, 1997, U.S. Appln. No. 60/056,293 filed on Aug. 29, 1997, U.S. Appln. No. 60/050,935 filed on May 30, 1997, U.S. Appln. No. 60/056,250 filed on Aug. 29, 1997, U.S. Appln. No. 60/049,610 filed on Jun. 13, 1997, U.S. Appln. No. 60/061,060 filed on Oct. 2, 1997, U.S. Appln. No. 60/049,606 filed on Jun. 13, 1997, U.S. Appln. No. 60/060,841 filed on Oct. 2, 1997, U.S. Appln. No. 60/049,550 filed on Jun. 13, 1997, U.S. Appln. No. 60/060,834 filed on Oct. 2, 1997, U.S. Appln. No. 60/049,549 filed on Jun. 13, 1997, U.S. Appln. No. 60/060,865 filed on Oct. 2, 1997, U.S. Appln. No. 60/049,548 filed on Jun. 13, 1997, U.S. Appln. No. 60/060,844 filed on Oct. 2, 1997, U.S. Appln. No. 60/049,547 filed on Jun. 13, 1997, U.S. Appln. No. 60/061,059 filed on Oct. 2, 1997, U.S. Appln. No. 60/051,381 filed on Jul. 1, 1997, U.S. Appln. No. 60/058,598 filed on Sep. 12, 1997, U.S. Appln. No. 60/051,480 filed on Jul. 1, 1997, U.S. Appln. No. 60/058,663 filed on Sep. 12, 1997, U.S. Appln. No. 60/051,926 filed on Jul. 8, 1997, U.S. Appln. No. 60/058,785 filed on Sep. 12, 1997, U.S. Appln. No. 60/052,793 filed on Jul. 8, 1997, U.S. Appln. No. 60/058,664 filed on Sep. 12, 1997, U.S. Appln. No. 60/051,925 filed on Jul. 8, 1997, U.S. Appln. No. 60/058,660 filed on Sep. 12, 1997, U.S. Appln. No. 60/051,929 filed on Jul. 8, 1997, U.S. Appln. No. 60/058,661 filed on Sep. 12, 1997, U.S. Appln. No. 60/052,803 filed on Jul. 8, 1997, U.S. Appln. No. 60/055,722 filed on Aug. 18, 1997, U.S. Appln. No. 60/052,732 filed on Jul. 8, 1997, U.S. Appln. No. 60/055,723 filed on Aug. 18, 1997, U.S. Appln. No. 60/051,932 filed on Jul. 8, 1997, U.S. Appln. No. 60/055,948 filed on Aug. 18, 1997, U.S. Appln. No. 60/051,931 filed on Jul. 8, 1997, U.S. Appln. No. 60/055,949 filed on Aug. 18, 1997, U.S. Appln. No. 60/051,916 filed on Jul. 8, 1997, U.S. Appln. No. 60/055,953 filed on Aug. 18, 1997, U.S. Appln. No. 60/051,930 filed on Jul. 8, 1997, U.S. Appln. No. 60/055,950 filed on Aug. 18, 1997, U.S. Appln. No. 60/051,918 filed on Jul. 8, 1997, U.S. Appln. No. 60/055,947 filed on Aug. 18, 1997, U.S. Appln. No. 60/051,920 filed on Jul. 8, 1997, U.S. Appln. No. 60/055,964 filed on Aug. 18, 1997, U.S. Appln. No. 60/052,733 filed on Jul. 8, 1997, U.S. Appln. No. 60/056,360 filed on Aug. 18, 1997, U.S. Appln. No. 60/052,795 filed on Jul. 8, 1997, U.S. Appln. No. 60/055,684 filed on Aug. 18, 1997, U.S. Appln. No. 60/051,919 filed on Jul. 8, 1997, U.S. Appln. No. 60/055,984 filed on Aug. 18, 1997, U.S. Appln. No. 60/051,928 filed on Jul. 8, 1997, U.S. Appln. No. 60/055,954 filed on Aug. 18, 1997, U.S. Appln. No. 60/052,870 filed on Jul. 16, 1997, U.S. Appln. No. 60/055,952 filed on Aug. 18, 1997, U.S. Appln. No. 60/052,871 filed on Jul. 16, 1997, U.S. Appln. No. 60/055,725 filed on Aug. 18, 1997, U.S. Appln. No. 60/052,872 filed on Jul. 16, 1997, U.S. Appln. No. 60/056,359 filed on Aug. 18, 1997, U.S. Appln. No. 60/052,661 filed on Jul. 16, 1997, U.S. Appln. No. 60/055,985 filed on Aug. 18, 1997, U.S. Appln. No. 60/052,874 filed on Jul. 16, 1997, U.S. Appln. No. 60/055,724 filed on Aug. 18, 1997, U.S. Appln. No. 60/052,873 filed on Jul. 16, 1997, U.S. Appln. No. 60/055,726 filed on Aug. 18, 1997, U.S. Appln. No. 60/052,875 filed on Jul. 16, 1997, U.S. Appln. No. 60/056,361 filed on Aug. 18, 1997, U.S. Appln. No. 60/053,440 filed on Jul. 22, 1997, U.S. Appln. No. 60/055,989 filed on Aug. 18, 1997, U.S. Appln. No. 60/053,441 filed on Jul. 22, 1997, U.S. Appln. No. 60/055,946 filed on Aug. 18, 1997, U.S. Appln. No. 60/053,442 filed on Jul. 22, 1997, U.S. Appln. No. 60/055,683 filed on Aug. 18, 1997, U.S. Appln. No. 60/054,212 filed on Jul. 30, 1997, U.S. Appln. No. 60/055,968 filed on Aug. 18, 1997, U.S. Appln. No. 60/054,209 filed on Jul. 30, 1997, U.S. Appln. No. 60/055,972 filed on Aug. 18, 1997, U.S. Appln. No. 60/054,234 filed on Jul. 30, 1997, U.S. Appln. No. 60/055,969 filed on Aug. 18, 1997, U.S. Appln. No. 60/055,386 filed on Aug. 5, 1997, U.S. Appln. No. 60/055,986 filed on Aug. 18, 1997, U.S. Appln. No. 60/054,807 filed on Aug. 5, 1997, U.S. Appln. No. 60/055,970 filed on Aug. 18, 1997, U.S. Appln. No. 60/054,215 filed on Jul. 30, 1997, U.S. Appln. No. 60/056,543 filed on Aug. 19, 1997, U.S. Appln. No. 60/054,218 filed on Jul. 30, 1997, U.S. Appln. No. 60/056,561 filed on Aug. 19, 1997, U.S. Appln. No. 60/054,214 filed on Jul. 30, 1997, U.S. Appln. No. 60/056,534 filed on Aug. 19, 1997, U.S. Appln. No. 60/054,236 filed on Jul. 30, 1997, U.S. Appln. No. 60/056,729 filed on Aug. 19, 1997, U.S. Appln. No. 60/054,213 filed on Jul. 30, 1997, U.S. Appln. No. 60/056,727 filed on Aug. 19, 1997, U.S. Appln. No. 60/054,211 filed on Jul. 30, 1997, U.S. Appln. No. 60/056,554 filed on Aug. 19, 1997, U.S. Appln. No. 60/054,217 filed on Jul. 30, 1997, U.S. Appln. No. 60/056,730 filed on Aug. 19, 1997, U.S. Appln. No. 60/055,312 filed on Aug. 5, 1997, U.S. Appln. No. 60/056,563 filed on Aug. 19, 1997, U.S. Appln. No. 60/055,309 filed on Aug. 5, 1997, U.S. Appln. No. 60/056,557 filed on Aug. 19, 1997, U.S. Appln. No. 60/055,310 filed on Aug. 5, 1997, U.S. Appln. No. 60/056,371 filed on Aug. 19, 1997, U.S. Appln. No. 60/054,798 filed on Aug. 5, 1997, U.S. Appln. No. 60/056,732 filed on Aug. 19, 1997, U.S. Appln.

No. 60/056,369 filed on Aug. 19, 1997, U.S. Appln. No. 60/056,535 filed on Aug. 19, 1997, U.S. Appln. No. 60/056,556 filed on Aug. 19, 1997, U.S. Appln. No. 60/056,555 filed on Aug. 19, 1997, U.S. Appln. No. 60/054,806 filed on Aug. 5, 1997, U.S. Appln. No. 60/056,366 filed on Aug. 19, 1997, U.S. Appln. No. 60/054,809 filed on Aug. 5, 1997, U.S. Appln. No. 60/056,364 filed on Aug. 19, 1997, U.S. Appln. No. 60/054,804 filed on Aug. 5, 1997, U.S. Appln. No. 60/056,370 filed on Aug. 19, 1997, U.S. Appln. No. 60/054,803 filed on Aug. 5, 1997, U.S. Appln. No. 60/056,731 filed on Aug. 19, 1997, U.S. Appln. No. 60/055,311 filed on Aug. 5, 1997, U.S. Appln. No. 60/056,365 filed on Aug. 19, 1997, U.S. Appln. No. 60/054,808 filed on Aug. 5, 1997, U.S. Appln. No. 60/056,367 filed on Aug. 19, 1997, U.S. Appln. No. 60/056,726 filed on Aug. 19, 1997, U.S. Appln. No. 60/056,368 filed on Aug. 19, 1997, U.S. Appln. No. 60/056,728 filed on Aug. 19, 1997, U.S. Appln. No. 60/056,628 filed on Aug. 19, 1997, U.S. Appln. No. 60/056,629 filed on Aug. 19, 1997, U.S. Appln. No. 60/056,270 filed on Aug. 29, 1997, U.S. Appln. No. 60/056,271 filed on Aug. 29, 1997, U.S. Appln. No. 60/056,247 filed on Aug. 29, 1997, U.S. Appln. No. 60/056,073 filed on Aug. 29, 1997, U.S. Appln. No. 60/057,669 filed on Sep. 5, 1997, U.S. Appln. No. 60/057,663 filed on Sep. 5, 1997, U.S. Appln. No. 60/057,626 filed on Sep. 5, 1997, U.S. Appln. No. 60/058,666 filed on Sep. 12, 1997, U.S. Appln. No. 60/058,973 filed on Sep. 12, 1997, U.S. Appln. No. 60/058,974 filed on Sep. 12, 1997, U.S. Appln. No. 60/058,667 filed on Sep. 12, 1997, U.S. Appln. No. 60/060,837 filed on Oct. 2, 1997, U.S. Appln. No. 60/060,862 filed on Oct. 2, 1997, U.S. Appln. No. 60/060,839 filed on Oct. 2, 1997, U.S. Appln. No. 60/060,866 filed on Oct. 2, 1997, U.S. Appln. No. 60/060,843 filed on Oct. 2, 1997, U.S. Appln. No. 60/060,836 filed on Oct. 2, 1997, U.S. Appln. No. 60/060,838 filed on Oct. 2, 1997, U.S. Appln. No. 60/060,874 filed on Oct. 2, 1997, U.S. Appln. No. 60/060,833 filed on Oct. 2, 1997, U.S. Appln. No. 60/060,884 filed on Oct. 2, 1997, U.S. Appln. No. 60/060,880 filed on Oct. 2, 1997, U.S. Appln. No. 60/061,463 filed on Oct. 9, 1997, U.S. Appln. No. 60/061,529 filed on Oct. 9, 1997, U.S. Appln. No. 60/071,498 filed on Oct. 9, 1997, U.S. Appln. No. 60/061,527 filed on Oct. 9, 1997, U.S. Appln. No. 60/061,536 filed on Oct. 9, 1997, U.S. Appln. No. 60/061,532 filed on Oct. 9, 1997, U.S. Appln. No. 60/063,099 filed on Oct. 24, 1997, U.S. Appln. No. 60/063,088 filed on Oct. 24, 1997, U.S. Appln. No. 60/063,100 filed on Oct. 24, 1997, U.S. Appln. No. 60/063,387 filed on Oct. 24, 1997, U.S. Appln. No. 60/063,148 filed on Oct. 24, 1997, U.S. Appln. No. 60/063,386 filed on Oct. 24, 1997, U.S. Appln. No. 60/062,784 filed on Oct. 24, 1997, U.S. Appln. No. 60/063,091 filed on Oct. 24, 1997, U.S. Appln. No. 60/063,090 filed on Oct. 24, 1997, U.S. Appln. No. 60/063,089 filed on Oct. 24, 1997, U.S. Appln. No. 60/063,092 filed on Oct. 24, 1997, U.S. Appln. No. 60/063,111 filed on Oct. 24, 1997, U.S. Appln. No. 60/063,101 filed on Oct. 24, 1997, U.S. Appln. No. 60/063,109 filed on Oct. 24, 1997, U.S. Appln. No. 60/063,110 filed on Oct. 24, 1997, U.S. Appln. No. 60/063,098 filed on Oct. 24, 1997, U.S. Appln. No. 60/063,097 filed on Oct. 24, 1997, U.S. Appln. No. 60/064,911 filed on Nov. 7, 1997, U.S. Appln. No. 60/064,912 filed on Nov. 7, 1997, U.S. Appln. No. 60/064,983 filed on Nov. 7, 1997, U.S. Appln. No. 60/064,900 filed on Nov. 7, 1997, U.S. Appln. No. 60/064,988 filed on Nov. 7, 1997, U.S. Appln. No. 60/064,987 filed on Nov. 7, 1997, U.S. Appln. No. 60/064,908 filed on Nov. 7, 1997, U.S. Appln. No. 60/064,984 filed on Nov. 7, 1997, U.S. Appln. No. 60/064,985 filed on Nov. 7, 1997, U.S. Appln. No. 60/066,094 filed on Nov. 17, 1997, U.S. Appln. No. 60/066,100 filed on Nov. 17, 1997, U.S. Appln. No. 60/066,089 filed on Nov. 17, 1997, U.S. Appln. No. 60/066,095 filed on Nov. 17, 1997, U.S. Appln. No. 60/066,090 filed on Nov. 17, 1997, U.S. Appln. No. 60/068,006 filed on Dec. 18, 1997, U.S. Appln. No. 60/068,057 filed on Dec. 18, 1997, U.S. Appln. No. 60/068,007 filed on Dec. 18, 1997, U.S. Appln. No. 60/068,008 filed on Dec. 18, 1997, U.S. Appln. No. 60/068,054 filed on Dec. 18, 1997, U.S. Appln. No. 60/068,064 filed on Dec. 18, 1997, U.S. Appln. No. 60/068,053 filed on Dec. 18, 1997, U.S. Appln. No. 60/070,923 filed on Dec. 18, 1997, U.S. Appln. No. 60/068,365 filed on Dec. 19, 1997, U.S. Appln. No. 60/068,169 filed on Dec. 19, 1997, U.S. Appln. No. 60/068,367 filed on Dec. 19, 1997, U.S. Appln. No. 60/068,369 filed on Dec. 19, 1997, U.S. Appln. No. 60/068,368 filed on Dec. 19, 1997, U.S. Appln. No. 60/070,657 filed on Jan. 7, 1998, U.S. Appln. No. 60/070,692 filed on Jan. 7, 1998, U.S. Appln. No. 60/070,704 filed on Jan. 7, 1998, U.S. Appln. No. 60/070,658 filed on Jan. 7, 1998, U.S. Appln. No. 60/073,160 filed on Jan. 30, 1998, U.S. Appln. No. 60/073,159 filed on Jan. 30, 1998, U.S. Appln. No. 60/073,165 filed on Jan. 30, 1998, U.S. Appln. No. 60/073,164 filed on Jan. 30, 1998, U.S. Appln. No. 60/073,167 filed on Jan. 30, 1998, U.S. Appln. No. 60/073,162 filed on Jan. 30, 1998, U.S. Appln. No. 60/073,161 filed on Jan. 30, 1998, U.S. Appln. No. 60/073,170 filed on Jan. 30, 1998, U.S. Appln. No. 60/074,141 filed on Feb. 9, 1998, U.S. Appln. No. 60/074,341 filed on Feb. 9, 1998, U.S. Appln. No. 60/074,037 filed on Feb. 9, 1998, U.S. Appln. No. 60/074,157 filed on Feb. 9, 1998, U.S. Appln. No. 60/074,118 filed on Feb. 9, 1998, U.S. Appln. No. 60/076,051 filed on Feb. 26, 1998, U.S. Appln. No. 60/076,053 filed on Feb. 26, 1998, U.S. Appln. No. 60/076,054 filed on Feb. 26, 1998, U.S. Appln. No. 60/076,052 filed on Feb. 26, 1998, U.S. Appln. No. 60/076,057 filed on Feb. 26, 1998, U.S. Appln. No. 60/077,714 filed on Mar. 12, 1998, U.S. Appln. No. 60/077,687 filed on Mar. 12, 1998, U.S. Appln. No. 60/077,686 filed on Mar. 12, 1998, U.S. Appln. No. 60/077,696 filed on Mar. 12, 1998, U.S. Appln. No. 60/078,566 filed on Mar. 19, 1998, U.S. Appln. No. 60/078,574 filed on Mar. 19, 1998, U.S. Appln. No. 60/078,576 filed on Mar. 19, 1998, U.S. Appln. No. 60/078,579 filed on Mar. 19, 1998, U.S. Appln. No. 60/078,563 filed on Mar. 19, 1998, U.S. Appln. No. 60/078,573 filed on Mar. 19, 1998, U.S. Appln. No. 60/078,578 filed on Mar. 19, 1998, U.S. Appln. No. 60/078,581 filed on Mar. 19, 1998, U.S. Appln. No. 60/078,577 filed on Mar. 19, 1998, U.S. Appln. No. 60/080,314 filed on Apr. 1, 1998, U.S. Appln. No. 60/080,312 filed on Apr. 1, 1998, U.S. Appln. No. 60/080,313 filed on Apr. 1, 1998, U.S. Appln. No. 60/085,180 filed on May 12, 1998, U.S. Appln. No. 60/085,105 filed on May 12, 1998, U.S. Appln. No. 60/085,094 filed on May 12, 1998, U.S. Appln. No. 60/085,093 filed on May 12, 1998, U.S. Appln. No. 60/085,924 filed on May 18, 1998, U.S. Appln. No. 60/085,906 filed on May 18, 1998, U.S. Appln. No. 60/085,927 filed on May 18, 1998, U.S. Appln. No. 60/085,920 filed on May 18, 1998, U.S. Appln. No. 60/085,928 filed on May 18, 1998, U.S. Appln. No. 60/085,925 filed on May 18, 1998, U.S. Appln. No. 60/085,921 filed on May 18, 1998, U.S. Appln. No. 60/085,923 filed on May 18, 1998, U.S. Appln. No. 60/085,922 filed on May 18, 1998, U.S. Appln. No. 60/090,112 filed on Jun. 22, 1998, U.S. Appln. No. 60/089,508 filed on Jun. 16, 1998, U.S. Appln. No. 60/089,507 filed on Jun. 16, 1998, U.S. Appln. No. 60/089,510 filed on Jun. 16, 1998, U.S. Appln. No. 60/089,509 filed on Jun. 16, 1998, U.S. Appln. No. 60/090,113 filed on Jun. 22, 1998, U.S. Appln. No. 60/092,956 filed on Jul. 15, 1998, U.S. Appln. No. 60/092,921 filed on Jul. 15, 1998, U.S. Appln. No. 60/092,922 filed on Jul. 15, 1998, U.S. Appln. No. 60/094,657 filed on Jul. 30, 1998, U.S. Appln. No. 60/095,486 filed on Aug. 5, 1998, U.S. Appln. No. 60/096,319 filed on Aug. 12, 1998, U.S. Appln. No. 60/095,455 filed on Aug. 6, 1998, U.S. Appln. No. 60/095,454 filed on Aug. 6, 1998, U.S. Appln. No. 60/097,917 filed on Aug. 25, 1998, U.S. Appln. No. 60/098,634 filed on Aug. 31, 1998, U.S. Appln. No. 60/101,546 filed on Sep. 23, 1998, U.S. Appln. No. 60/102,895 filed on Oct. 2, 1998, U.S. Appln. No. 60/108,207 filed on Nov. 12, 1998, U.S. Appln. No. 60/113,006 filed on Dec. 18, 1998, U.S. Appln. No. 60/112,809 filed on Dec. 17, 1998, U.S. Appln. No. 60/116,330 filed on Jan. 19, 1999, U.S. Appln. No. 60/119,468 filed on Feb. 10, 1999, U.S. Appln. No. 60/125,055 filed on Mar. 18, 1999, U.S. Appln. No. 60/128,693 filed on Apr. 9, 1999, U.S. Appln. No. 60/130,991 filed on Apr. 26, 1999, U.S. Appln. No. 60/137,725 filed on Jun. 7, 1999, U.S. Appln. No. 60/145,220 filed on Jul. 23, 1999, U.S. Appln. No. 60/149,182 filed on Aug. 17, 1999, U.S. Appln. No. 60/152,317 filed on Sep. 3, 1999, U.S. Appln. No. 60/152,315 filed on Sep. 3, 1999, U.S. Appln. No. 60/155,709 filed on Sep. 24, 1999, U.S. Appln. No. 60/163,085 filed on Nov. 2, 1999, U.S. Appln. No. 60/172,411 filed on Dec. 17, 1999, U.S. Appln. No. 60/162,239 filed on Oct. 29, 1999, U.S. Appln. No. 60/215,139 filed on Jun. 30, 2000, U.S. Appln. No. 60/162,211 filed on Oct. 29, 1999, U.S. Appln. No. 60/215,138 filed on Jun. 30, 2000, U.S. Appln. No. 60/162,240 filed on Oct. 29, 1999, U.S. Appln. No. 60/215,131 filed on Jun. 30, 2000, U.S. Appln. No. 60/162,237 filed on Oct. 29, 1999, U.S. Appln. No. 60/219,666 filed on Jul. 21, 2000, U.S. Appln. No. 60/162,238 filed on Oct. 29, 1999, U.S. Appln. No. 60/215,134 filed on Jun. 30, 2000, U.S. Appln. No. 60/163,580 filed on Nov. 5, 1999, U.S. Appln. No. 60/215,130 filed on Jun. 30, 2000, U.S. Appln. No. 60/163,577 filed on Nov. 5, 1999, U.S. Appln. No. 60/215,137 filed on Jun. 30, 2000, U.S. Appln. No. 60/163,581 filed on Nov. 5, 1999, U.S. Appln. No. 60/215,133 filed on Jun. 30, 2000, U.S. Appln. No. 60/163,576 filed on Nov. 5, 1999, U.S. Appln. No. 60/221,366 filed on Jul. 27, 2000, U.S. Appln. No. 60/164,344 filed on Nov. 9, 1999, U.S. Appln. No. 60/195,296 filed on Apr. 7, 2000, U.S. Appln. No. 60/221,367 filed on Jul. 27, 2000, U.S. Appln. No. 60/164,835 filed on Nov. 12, 1999, U.S. Appln. No. 60/221,142 filed on Jul. 27, 2000, U.S. Appln. No. 60/164,744 filed on Nov. 12, 1999, U.S. Appln. No. 60/215,140 filed on Jun. 30, 2000, U.S. Appln. No. 60/164,735 filed on Nov. 12, 1999, U.S. Appln. No. 60/221,193 filed on Jul. 27, 2000, U.S. Appln. No. 60/164,825 filed on Nov. 12, 1999, U.S. Appln. No. 60/222,904 filed on Aug. 3, 2000, U.S. Appln. No. 60/164,834 filed on Nov. 12, 1999, U.S. Appln. No. 60/224,007 filed on Aug. 4, 2000, U.S. Appln. No. 60/164,750 filed on Nov. 12, 1999, U.S. Appln. No. 60/215,128 filed on Jun. 30, 2000, U.S. Appln. No. 60/166,415 filed on Nov. 19, 1999, U.S. Appln. No. 60/215,136 filed on Jun. 30, 2000, U.S. Appln. No. 60/166,414 filed on Nov. 19, 1999, U.S. Appln. No. 60/219,665 filed on Jul. 21, 2000, U.S. Appln. No. 60/164,731 filed on Nov. 12, 1999, U.S. Appln. No. 60/215,132 filed on Jun. 30, 2000, U.S. Appln. No. 60/226,280 filed on Aug. 18, 2000, U.S. Appln. No. 60/256,968 filed on Dec. 21, 2000, U.S. Appln. No. 60/226,380 filed on Aug. 18, 2000, U.S. Appln. No. 60/259,803 filed on Jan. 5, 2001, U.S. Appln. No. 60/228,084 filed on Aug. 28, 2000, U.S. application Ser. No. 09/915,582 filed on Jul. 27, 2001, U.S. Appln. No. 60/231,968 filed on Sep. 12, 2000, U.S. Appln. No. 60/236,326 filed on Sep. 29, 2000, U.S. Appln. No. 60/234,211 filed on Sep. 20, 2000, U.S. Appln. No. 60/226,282 filed on Aug. 18, 2000, U.S. Appln. No. 60/232,104 filed on Sep. 12, 2000, U.S. Appln. No. 60/234,210 filed on Sep. 20, 2000, U.S. Appln. No. 60/226,278 filed on Aug. 18, 2000, U.S. Appln. No. 60/259,805 filed on Jan. 5, 2001, U.S. Appln. No. 60/226,279 filed on Aug. 18, 2000, U.S. Appln. No. 60/259,678 filed on Jan. 5, 2001, U.S. Appln. No. 60/226,281 filed on Aug. 18, 2000, U.S. Appln. No. 60/231,969 filed on Sep. 12, 2000, U.S. Appln. No. 60/228,086 filed on Aug. 28, 2000, U.S. Appln. No. 60/259,516 filed on Jan. 4, 2001, U.S. Appln. No. 60/228,083 filed on Aug. 28, 2000, U.S. Appln. No. 60/259,804 filed on Jan. 5, 2001, U.S. Appln. No. 60/270,658 filed on Feb. 23, 2001, U.S. Appln. No. 60/304,444 filed on Jul. 12, 2001, U.S. Appln. No. 60/270,625 filed on Feb. 23, 2001, U.S. Appln. No. 60/304,417 filed on Jul. 12, 2001, U.S. Appln. No. 60/295,869 filed on Jun. 6, 2001, U.S. Appln. No. 60/304,121 filed on Jul. 11, 2001, U.S. Appln. No. 60/311,085 filed on Aug. 10, 2001, U.S. Appln. No. 60/325,209 filed on Sep. 28, 2001, U.S. Appln. No. 60/330,629 filed on Oct. 26, 2001, U.S. Appln. No. 60/331,046 filed on Nov. 7, 2001, U.S. Appln. No. 60/358,554 filed on Feb. 22, 2002, U.S. Appln. No. 60/358,714 filed on Feb. 25, 2002, PCT Appln. No. US00/29363 filed on Oct. 25, 2000, PCT Appln. No. US00/29360 filed on Oct. 25, 2000, PCT Appln. No. US00/29362 filed on Oct. 25, 2000, PCT Appln. No. US00/29365 filed on Oct. 25, 2000, PCT Appln. No. US00/29364 filed on Oct. 25, 2000, PCT Appln. No. US00/30040 filed on Nov. 1, 2000, PCT Appln. No. US00/30037 filed on Nov. 1, 2000, PCT Appln. No. US00/30045 filed on Nov. 1, 2000, PCT Appln. No. US00/30036 filed on Nov. 1, 2000, PCT Appln. No. US00/30039 filed on Nov. 1, 2000, PCT Appln. No. US00/30654 filed on Nov. 8, 2000, PCT Appln. No. US00/30628 filed on Nov. 8, 2000, PCT Appln. No. US00/30653 filed on Nov. 8, 2000, PCT Appln. No. US00/30629 filed on Nov. 8, 2000, PCT Appln. No. US00/30679 filed on Nov. 8, 2000, PCT Appln. No. US00/30674 filed on Nov. 8, 2000, PCT Appln. No. US00/31162 filed on Nov. 15, 2000, PCT Appln. No. US00/31282 filed on Nov. 15, 2000, PCT Appln. No. US00/30657 filed on Nov. 8, 2000, PCT Appln. No. US01/01396 filed on Jan. 17, 2001, PCT Appln. No. US01/01387 filed on Jan. 17, 2001, PCT Appln. No. US01/01567 filed on Jan. 17, 2001, PCT Appln. No. US01/01431 filed on Jan. 17, 2001, PCT Appln. No. US01/01432 filed on Jan. 17, 2001, PCT Appln. No. US01/00544 filed on Jan. 9, 2001, PCT Appln. No. US01/01435 filed on Jan. 17, 2001, PCT Appln. No. US01/01386 filed on Jan. 17, 2001, PCT Appln. No. US01/01565 filed on Jan. 17, 2001, PCT Appln. No. US01/01394 filed on Jan. 17, 2001, PCT Appln. No. US01/01434 filed on Jan. 17, 2001, PCT Appln. No. US01/01397 filed on Jan. 17, 2001, PCT Appln. No. US01/01385 filed on Jan. 17, 2001, PCT Appln. No. US01/01384 filed on Jan. 17, 2001, PCT Appln. No. US01/01383 filed on Jan. 17, 2001, PCT Appln. No. (Atty. Dkt. No. PS735; unassigned) filed on Feb. 21, 2002, PCT Appln. No. (Atty. Dkt. No. PS736; unassigned) filed on Feb. 21, 2002, U.S. application Ser. No. 09/148,545 filed on Sep. 4, 1998, U.S. application Ser. No. 09/621,011 filed on Jul. 20, 2000, U.S. application Ser. No. 09/981,876 filed on Oct. 19, 2001, U.S. application Ser. No. 09/149,476 filed on Sep. 8, 1998, U.S. application Ser. No. 09/809,391 filed on Mar. 16, 2001, U.S. application Ser. No. 09/882,171 filed on Jun. 18, 2001, U.S. Appln. No. 60/190,068 filed on Mar. 17, 2000, U.S. application Ser. No. 09/152,060 filed on Sep. 11, 1998, U.S. application Ser. No. 09/852,797 filed on May 11, 2001, U.S. application Ser. No. 09/853,161 filed on May 11, 2001, U.S. application Ser. No. 09/852,659 filed on May 11, 2001, U.S. application Ser. No. 10/058,993 filed on Jan. 30, 2002, U.S. Appln. No. 60/265,583 filed on Feb. 2, 2001, U.S. application Ser. No. 09/154,707 filed on Sep. 17, 1998, U.S. application Ser. No. 09/966,262 filed on Oct. 1, 2001, U.S. application Ser. No. 09/983,966 filed on Oct. 26, 2001, U.S. application Ser. No. 10/059,395 filed on Jan. 31, 2002, U.S. application Ser. No. 09/984,245 filed on Oct. 29, 2001, U.S. application Ser. No. 09/166,780 filed on Oct. 6, 1998, U.S. application Ser. No. 09/577,145 filed on May 24, 2000, U.S.

application Ser. No. 09/814,122 filed on Mar. 22, 2001, U.S. application Ser. No. 09/189,144 filed on Nov. 10, 1998, U.S. application Ser. No. 09/690,454 filed on Oct. 18, 2000, U.S. Appln. No. (Atty. Dkt. No. PZ006G13A; unassigned) filed on Feb. 5, 2002, U.S. application Ser. No. 10/062,599 filed on Feb. 5, 2002, U.S. application Ser. No. 09/205,258 filed on Dec. 4, 1998, U.S. application Ser. No. 09/933,767 filed on Aug. 22, 2001, U.S. Appln. No. 60/184,836 filed on Feb. 24, 2000, U.S. Appln. No. 60/193,170 filed on Mar. 29, 2000, U.S. application Ser. No. 10/023,282 filed on Dec. 20, 2001, U.S. application Ser. No. 10/004,860 filed on Dec. 7, 2001, U.S. application Ser. No. 09/209,462 filed on Dec. 11, 1998, U.S. application Ser. No. 09/213,365 filed on Dec. 17, 1998, U.S. application Ser. No. 09/627,081 filed on Jul. 27, 2000, U.S. application Ser. No. 09/227,357 filed on Jan. 8, 1999, U.S. application Ser. No. 09/983,802 filed on Oct. 25, 2001, U.S. application Ser. No. 09/973,278 filed on Oct. 10, 2001, U.S. Appln. No. 60/239,899 filed on Oct. 13, 2000, U.S. application Ser. No. 09/984,490 filed on Oct. 30, 2001, U.S. application Ser. No. 09/776,724 filed on Feb. 6, 2001, U.S. application Ser. No. 09/229,982 filed on Jan. 14, 1999, U.S. application Ser. No. 09/669,688 filed on Sep. 26, 2000, U.S. Appln. No. 60/180,909 filed on Feb. 8, 2000, U.S. application Ser. No. 09/236,557 filed on Jan. 26, 1999, U.S. application Ser. No. 09/666,984 filed on Sep. 21, 2000, U.S. application Ser. No. 09/820,649 filed on Mar. 30, 2001, U.S. Appln. No. 60/295,558 filed on Jun. 5, 2001, U.S. application Ser. No. 09/244,112 filed on Feb. 4, 1999, U.S. application Ser. No. 09/774,639 filed on Feb. 1, 2001, U.S. application Ser. No. 09/969,730 filed on Oct. 4, 2001, U.S. Appln. No. 60/238,291 filed on Oct. 6, 2000, U.S. application Ser. No. 09/251,329 filed on Feb. 17, 1999, U.S. application Ser. No. 09/716,128 filed on Nov. 17, 2000, U.S. application Ser. No. 09/257,179 filed on Feb. 25, 1999, U.S. application Ser. No. 09/729,835 filed on Dec. 6, 2000, U.S. application Ser. No. 09/262,109 filed on Mar. 4, 1999, U.S. application Ser. No. 09/722,329 filed on Nov. 28, 2000, U.S. Appln. No. (Atty. Dkt. No. PZ016P1C1; unassigned) filed on Jan. 17, 2002, U.S. Appln. No. 60/262,066 filed on Jan. 18, 2001, U.S. application Ser. No. 09/281,976 filed on Mar. 31, 1999, U.S. application Ser. No. 09/288,143 filed on Apr. 8, 1999, U.S. application Ser. No. 09/984,429 filed on Oct. 30, 2001, U.S. Appln. No. 60/244,591 filed on Nov. 1, 2000, U.S. application Ser. No. 09/296,622 filed on Apr. 23, 1999, U.S. application Ser. No. 09/305,736 filed on May 5, 1999, U.S. application Ser. No. 09/818,683 filed on Mar. 28, 2001, U.S. application Ser. No. 09/974,879 filed on Oct. 12, 2001, U.S. Appln. No. 60/239,893 filed on Oct. 13, 2000, U.S. application Ser. No. 09/334,595 filed on Jun. 17, 1999, U.S. application Ser. No. 09/348,457 filed on Jul. 7, 1999, U.S. application Ser. No. 09/739,907 filed on Dec. 20, 2000, U.S. application Ser. No. 09/938,671 filed on Aug. 27, 2001, U.S. application Ser. No. 09/363,044 filed on Jul. 29, 1999, U.S. application Ser. No. 09/813,153 filed on Mar. 21, 2001, U.S. application Ser. No. 09/949,925 filed on Sep. 12, 2001, U.S. Appln. No. 60/232,150 filed on Sep. 12, 2000, U.S. application Ser. No. 09/369,247 filed on Aug. 5, 1999, U.S. application Ser. No. 10/062,548 filed on Feb. 5, 2002, U.S. application Ser. No. 09/382,572 filed on Aug. 25, 1999, U.S. application Ser. No. 09/716,129 filed on Nov. 17, 2000, U.S. application Ser. No. 09/393,022 filed on Sep. 9, 1999, U.S. application Ser. No. 09/798,889 filed on Mar. 6, 2001, U.S. application Ser. No. 09/397,945 filed on Sep. 17, 1999, U.S. application Ser. No. 09/437,658 filed on Nov. 10, 1999, U.S. application Ser. No. 09/892,877 filed on Jun. 28, 2001, U.S. application Ser. No. 09/948,783 filed on Sep. 10, 2001, U.S. Appln. No. 60/231,846 filed on Sep. 11, 2000, U.S. application Ser. No. 09/461,325 filed on Dec. 14, 1999, U.S. application Ser. No. 10/050,873 filed on Jan. 18, 2002, U.S. Appln. No. 60/263,230 filed on Jan. 23, 2001, U.S. Appln. No. 60/263,681 filed on Jan. 24, 2001, U.S. application Ser. No. 10/012,542 filed on Dec. 12, 2001, U.S. application Ser. No. 09/482,273 filed on Jan. 13, 2000, U.S. Appln. No. 60/234,925 filed on Sep. 25, 2000, U.S. application Ser. No. 09/984,276 filed on Oct. 29, 2001, U.S. application Ser. No. 09/984,271 filed on Oct. 29, 2001, U.S. application Ser. No. 09/489,847 filed on Jan. 24, 2000, U.S. Appln. No. 60/350,898 filed on Jan. 25, 2002, U.S. application Ser. No. 09/511,554 filed on Feb. 23, 2000, U.S. application Ser. No. 09/739,254 filed on Dec. 19, 2000, U.S. application Ser. No. 09/904,615 filed on Jul. 16, 2001, U.S. application Ser. No. 10/054,988 filed on Jan. 25, 2002, U.S. application Ser. No. 09/531,119 filed on Mar. 20, 2000, U.S. application Ser. No. 09/820,893 filed on Mar. 30, 2001, U.S. application Ser. No. 09/565,391 filed on May 5, 2000, U.S. application Ser. No. 09/948,820 filed on Sep. 10, 2001, U.S. application Ser. No. 09/591,316 filed on Jun. 9, 2000, U.S. application Ser. No. 09/895,298 filed on Jul. 2, 2001, U.S. application Ser. No. 09/618,150 filed on Jul. 17, 2000, U.S. application Ser. No. 09/985,153 filed on Nov. 1, 2001, U.S. application Ser. No. 09/628,508 filed on Jul. 28, 2000, U.S. application Ser. No. 09/997,131 filed on Nov. 30, 2001, U.S. application Ser. No. 09/661,453 filed on Sep. 13, 2000, U.S. application Ser. No. 10/050,882 filed on Jan. 18, 2002, U.S. application Ser. No. 09/684,524 filed on Oct. 10, 2000, U.S. application Ser. No. 10/050,704 filed on Jan. 18, 2002, U.S. application Ser. No. 09/726,643 filed on Dec. 1, 2000, U.S. application Ser. No. 10/042,141 filed on Jan. 11, 2002, U.S. application Ser. No. 09/756,168 filed on Jan. 9, 2001, U.S. application Ser. No. 09/781,417 filed on Feb. 13, 2001, U.S. Appln. No. (Atty. Dkt. No. PZ042P1C1; unassigned) filed on Feb. 1, 2002, U.S. application Ser. No. 09/789,561 filed on Feb. 22, 2001, U.S. application Ser. No. 09/800,729 filed on Mar. 8, 2001, U.S. application Ser. No. 09/832,129 filed on Apr. 11, 2001, PCT Appln. No. US98/04482 filed on Mar. 6, 1998, PCT Appln. No. US98/04493 filed on Mar. 6, 1998, PCT Appln. No. US98/04858 filed on Mar. 12, 1998, PCT Appln. No. US98/05311 filed on Mar. 19, 1998, PCT Appln. No. US98/06801 filed on Apr. 7, 1998, PCT Appln. No. US98/10868 filed on May 28, 1998, PCT Appln. No. US98/11422 filed on Jun. 4, 1998, PCT Appln. No. US01/05614 filed on Feb. 21, 2001, PCT Appln. No. US98/12125 filed on Jun. 11, 1998, PCT Appln. No. US98/13608 filed on Jun. 30, 1998, PCT Appln. No. US98/13684 filed on Jul. 7, 1998, PCT Appln. No. US98/14613 filed on Jul. 15, 1998, PCT Appln. No. US98/15949 filed on Jul. 29, 1998, PCT Appln. No. US98/16235 filed on Aug. 4, 1998, PCT Appln. No. US98/17044 filed on Aug. 18, 1998, PCT Appln. No. US98/17709 filed on Aug. 27, 1998, PCT Appln. No. US98/18360 filed on Sep. 3, 1998, PCT Appln. No. (Atty. Dkt. No. PZ016PCT2; unassigned) filed on Jan. 17, 2002, PCT Appln. No. US98/20775 filed on Oct. 1, 1998, PCT Appln. No. US98/21142 filed on Oct. 8, 1998, PCT Appln. No. US98/22376 filed on Oct. 23, 1998, PCT Appln. No. US98/23435 filed on Nov. 4, 1998, PCT Appln. No. US98/27059 filed on Dec. 17, 1998, PCT Appln. No. US99/00108 filed on Jan. 6, 1999, PCT Appln. No. US99/01621 filed on Jan. 27, 1999, PCT Appln. No. US99/02293 filed on Feb. 4, 1999, PCT Appln. No. US99/03939 filed on Feb. 24, 1999, PCT Appln. No. US99/05721 filed on Mar. 1, 1999, PCT Appln. No. US99/05804 filed on Mar. 18, 1999, PCT Appln. No. US99/09847 filed on May 6, 1999, PCT Appln. No. US99/13418 filed on Jun. 15, 1999, PCT Appln. No. US99/15849 filed on Jul. 14, 1999, PCT Appln. No. US01/00911 filed on Jan. 12, 2001, PCT Appln. No. US01/29871 filed on Sep. 24, 2001, PCT Appln. No. US99/17130 filed on Jul. 29, 1999, PCT Appln. No. US99/19330 filed on Aug. 24, 1999, PCT Appln. No. US99/22012 filed on Sep. 22, 1999, PCT Appln. No. US99/26409 filed on Nov. 9, 1999, PCT Appln. No. US99/29950 filed on Dec. 16, 1999, PCT Appln. No. US00/00903 filed on Jan. 18, 2000, PCT Appln. No. US00/03062 filed on Feb. 8, 2000, PCT Appln. No. US00/06783 filed on Mar. 16, 2000, PCT Appln. No. US00/08979 filed on Apr. 6, 2000, PCT Appln. No. US00/15187 filed on Jun. 2, 2000, PCT Appln. No. US00/19735 filed on Jul. 20, 2000, PCT Appln. No. US00/22325 filed on Aug. 16, 2000, PCT Appln. No. US00/24008 filed on Aug. 31, 2000, PCT Appln. No. US00/26013 filed on Sep. 22, 2000, PCT Appln. No. US00/28664 filed on Oct. 17, 2000, U.S. application Ser. No. 09/833,245 filed on Apr. 12, 2001, U.S. application Ser. No. 10/100,683 filed on Mar. 19, 2002, and PCT Appln. No. US01/11988 filed on Apr. 12, 2001.

LENGTHY TABLES

The patent contains a lengthy table section. A copy of the table is available in electronic form from the USPTO web site (http://seqdata.uspto.gov/?pageRequest=docDetail&DocID=US07411051B2). An electronic copy of the table will also be available from the USPTO upon request and payment of the fee set forth in 37 CFR 1.19(b)(3).

SEQUENCE LISTING (13468 sequences)

SEQ ID NO: 1 - DNA, 733 bp, Homo sapiens
gggatccggagcccaaatcttctgacaaaactcacacatgcccaccgtgcccagcacctgaattcgagggtgcaccgtcagtcttcctcttccccccaaaacccaaggacaccctcatgatctcccggactcctgaggtcacatgcgtggtggtggacgtaagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaacccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccgcgactctagaggat

SEQ ID NO: 2 - protein, 5 aa, Homo sapiens
  Site (3): Xaa equals any amino acid
WSXWS

SEQ ID NO: 3 - DNA, 86 bp, Artificial Sequence
  Primer_Bind: Synthetic sequence with 4 tandem copies of the GAS binding site found in the IRF1 promoter (Rothman et al., Immunity 1:457-468 (1994)), 18 nucleotides complementary to the SV40 early promoter, and a Xho I restriction site.
gcgcctcgagatttccccgaaatctagatttccccgaaatgatttccccgaaatgatttccccgaaatatctgccatctcaattag

SEQ ID NO: 4 - DNA, 27 bp, Artificial Sequence
  Primer_Bind: Synthetic sequence complementary to the SV40 promter; includes a Hind III restriction site.
gcggcaagctttttgcaaagcctaggc

SEQ ID NO: 5 - DNA, 271 bp, Artificial Sequence
  Protein_Bind: Synthetic promoter for use in biological assays; includes GAS binding sites found in the IRF1 promoter (Rothman et al., Immunity 1:457-468 (1994)).
ctcgagatttccccgaaatctagatttccccgaaatgatttccccgaaatgatttccccgaaatatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 6 - DNA, 32 bp, Artificial Sequence
  Primer_Bind: Synthetic primer complementary to human genomic EGR-1 promoter sequence (Sakamoto et al., Oncogene 6:867-871 (1991)); includes a Xho I restriction site.
gcgctcgagggatgacagcgatagaaccccgg

SEQ ID NO: 7 - DNA, 31 bp, Artificial Sequence
  Primer_Bind: Synthetic primer complementary to human genomic EGR-1 promoter sequence (Sakamoto et al., Oncogene 6:867-871 (1991)); includes a Hind III restriction site.
gcgaagcttcgcgactccccggatccgcctc

SEQ ID NO: 8 - DNA, 12 bp, Homo sapiens
ggggactttccc

SEQ ID NO: 9 - DNA, 73 bp, Artificial Sequence
  Primer_Bind: Synthetic primer with 4 tandem copies of the NF-KB binding site (GGGGACTTTCCC), 18 nucleotides complementary to the 5' end of the SV40 early promoter sequence, and a XhoI restriction site.
gcggcctcgaggggactttcccggggactttccggggactttccgggactttccatcctgccatctcaattag

SEQ ID NO: 10 - DNA, 256 bp, Artificial Sequence
  Protein_Bind: Synthetic promoter for use in biological assays; includes NF-KB binding sites.
ctcgaggggactttcccggggactttccggggactttccgggactttccatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 11 - DNA, 2797 bp, Homo sapiens
  misc_feature (853)..(853): n equals a,t,g, or c
ggcacgagagagcagacagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagaggaccttcttcagtcagtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaaagactggagcagtctatgtagcagaaattggagcaaaacaagtacaaaaatatgtccctttgaatagctatgttccttcatttggttcataatgtttctttcccgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgngtaaaaaaaatgggaataaaaatgagcttgcatgataatttattaaatttcatgtgaagaactccagacctccagattgtgcaactaacataaagtgagctgcttgagagattgtaaataagatgaactattgattaatttgagtacccacagagtgctgtgtcttgacgacttaaaaatgaaaaagcatgattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcactttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagaccttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacatacttgccctttggaaatctaatacctctgggataccattaagaggcattttaattaaacaaaagggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgwtttrtrtcagagtyttawaarvcctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaaaaaaaaaaaaaaaaaaaaaaaaaaaaaaaaaaaaaaaaaaaaaaaaaaaa

SEQ ID NO: 12 - DNA, 2703 bp, Homo sapiens
ggcacgagatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaaaaaaaaaaaaaaaaaaa

SEQ ID NO: 13 - DNA, 459 bp, Homo sapiens
ggcacgaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaaagttatcaatcaagctaacaactgttaaataaaatatgttctattctcctactttgaaaaaaaaaaaaaaaaaa

SEQ ID NO: 14 - DNA, 1939 bp, Homo sapiens
gcacgagcggctgcgggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagtgaccttcccagaaaggagacggagcagccgcctgcgccggggagcatggaggagacgtgagaagctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaag

SEQ ID NO: 15 - DNA, 760 bp, Homo sapiens
  misc_feature (13)..(13): n equals a,t,g, or c
  misc_feature (300)..(300): n equals a,t,g, or c
  misc_feature (425)..(425): n equals a,t,g, or c
cggacgcgtgggncggacgcgtggggaaaaaataacaaaacaaaaaacaagaaaaaaaaaacacaaaaccccgtaaaatcacaaagaaaatccaacaccaaaggcgcagaagccggctggccgtggtgggggcagcgtaggcgtasatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccangggtctgccgggtgggggtgccaacaggcctggccctttcctcccctgcatccagccatgggggcctctgcgattgccggaaggttgcatggctggtcccagggccagcacaggcccgaggccgngctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttccaaa

SEQ ID NO: 16 - DNA, 540 bp, Homo sapiens
  misc_feature (341)..(341): n equals a,t,g, or c
  misc_feature (378)..(378): n equals a,t,g, or c
  misc_feature (425)..(425): n equals a,t,g, or c
  misc_feature (450)..(450): n equals a,t,g, or c
gaggatccccacagggcccctctgtagccctggggagtcggcagtgctggtctaggccccttaggagagggggcaggggggcagcagtagaaatgtggcggggtccgacttggtgtttccggccgtctttgtgtctrtgttgtgtatgtggagtgtcattcggtctttatgtccctcacggcttcagtctctccatgtgtgtttctgccccaggctctgcctggctgtcccttgtgtattccatctgtctagcccgtggttccatgtcagamcggstttcttctcgggamagcctggttgcatctggggcatctgttttgttggtttgcttctgggtgcangcagacccaggagtgggtgtctctgttccccgagcanctgtctctggtctctggtggtgtgtgagtccatctgcctgcctcganttggccccaaccaagccccccccanccctctctttctctctctcaatcttccctttctcttccaacccctccaaatgagatggttgagtgccgtgggttggagggaagcaatggt

SEQ ID NO: 17 - DNA, 1774 bp, Homo sapiens
taggcaccccaggcttttacactttatgttccggttcgtatgttgtgtgaattgtaaccggataccaatttcacacaaggaaccagcttatgaccatgattacgccaagctcgaaattaaccctcactaaagggaacaaaagctggagctccaccgcggtggcggccgctctagaactagtggatcccccgggctgcaggaattcggcacgagcggctgcgggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagtgaccttcccagaaaggagacggagcagccgcctgcgccggggagcatggaggagaacgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaaaaaaaaaaaaaaaaactcgagggggggcccgg

SEQ ID NO: 18 - DNA, 654 bp, Homo sapiens
  misc_feature (613)..(613): n equals a,t,g, or c
  misc_feature (623)..(623): n equals a,t,g, or c
ggtcgacccacgcgtccggtcatggccatccagagcctgcacccttgcccctcagagctctgctgcagggcctgcgtgasyttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaanmaaaaaaaanaaaaaaaaaaaaaaaaaaaaaaaaaaaaaaa

SEQ ID NO: 19 - DNA, 1445 bp, Homo sapiens
ggcacgagggatttgaacaagatcattagaattcaaaaaacaccagaaatgaaagatctttcctgaagctgtttaggaatattcatgatatacccttaactgttctagagaacaaaatgcgtctgtgctccttcacaaaagtccctatgaatttgtttctcaatgtgatccttcttaagttctataactttttgttttcattaattttaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacgggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatatatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaaaaaaaaaaaaaaaaaa

SEQ ID NO: 20 - DNA, 1722 bp, Homo sapiens
ggcacgagccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagctggcagaccyaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcacsgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaargcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaaaaaaaaaaaaaaaaaaaaaaaaaaa

SEQ ID NO: 21 - DNA, 1453 bp, Homo sapiens
  misc_feature (946)..(946): n equals a,t,g, or c
ggtcatctttctcttgctcgtacagagaggagacacccgtagaaatggagatttctactacagatgaaaatttcttttataaaagggtaacttctctgtattatcctgtgtttgctatttctgaaaataataagctgaaaatattcctctttggcataaggattatttggtgtggcatgttctgaacctccactgttggcatcctttcttgattagcagaaacctaggaacattgttgtaataatgactaaattattgtcactgtcacatttgttagtaactttttttaatataattgccattaaatgtaaaaagcagcatctaagacattcaaaatgtaatttkgatactacttttaaaaataagatgctaaattaatagataaggtgggtttcctcagtatattttcattctaaaccatccactaaagtagggctaaagaggaatttagagtaggaagacttaggttttgtattctgcctttgttcagtatcagtgtgactttggccaagttacctgacttctgaactgcattttgcttttctctaaataagtgggggtaatacctatattagaggattatgataaaaagatgtgaacatattataaaattattttataaactagaagacatttcaaagaagttaagctgccactgttagtttcacagacttgggtgtattagatgaacagcttttcagttattgcttctatagttgtcctcttgccctttcctggattatcagtttctgcctgtctacctagtcattcccatcagtgtaaaacatttataytgttatttcttccaagttcagaaaaaaccctctytygaytccccccatcccattccagcactttgggaggccaaggcgggcagatcatgaggtcaggagatcgagmccatyctggctaacatggtgacccccatctctactaaaaatacaanacaaattagccgggcttggtggtgggcgcctgtaatcccagctaccggggaggctgaggcaggagaaaggcatgaacccaggaggcagagcttgcagtgagccaagattgcgccattgcactccagcctgggcgacagagtgagactccatctcaaaaaaamgaawaaaaaaaacaacttattttaaattattttcctagaaattatgatgtcagcagaggtagctaggtggtattatggttgacttttgttatttttaagacagcttccgtatttcttaggagttttgctgaagaacatggtatggggagaacatataatattctcatacacttcttaggatgggatagatccctgtaacagaatattggttaacaagagaaaaacaagttttaagacatgtatacctcatatatacatgggagatactcgggggaagtgagtaaatctctcagaggtggcttaaataccatcatgtcctgaaaaaaaaaaaaaaagggcggccgc

SEQ ID NO: 22 - DNA, 1032 bp, Homo sapiens
  misc_feature (974)..(974): n equals a,t,g, or c
gtaaaattgtcaaacatttatttttaaaaataaaatgtggtgggcggttatgggtggagttattgggtcctggctgtcgccactgagcattgctgaatgttgtcatgacttgtggacttctcagagctgcgagcatgcgggtgctctttgtggagatttgctctgtgcctgtaggaaggtgggtgtgtggtgtgcattgcagcaacattggtggaacagatgtgtgtgcccccatgctgtcatcagggttcattgcacaggagcctcatacacactacagaaaatatgctcttgtaaccccaagttcatggggaggcatccacacagatggcagcagatcaggaaatgctctcagccagtcctcaggggcagtagggcagccttcatctgggtgcgcttggcagccctgaactttatctcttcttttcgttgtatttctttaatatcttattcagcattttagtttctttagttggatgagttgttcagtgtctttgtactgtacagttctcctgtgctgttggaatggacgtcatgggctatgttactcttttgaaatacaaatttctctttagaagttttggaaaatctgttagaggaggagttctgagaatatgagaagacttcttgccacatagttgtgcctgcccgatgtatttttccaaaaaaattgaaggtgaacctgttggaagctcagttctgagtttaattgactactttgcagagacacaacactctctttstagcatgtcccttggaagaaaataggctggtgcttgggtggtgatcagaactggcagttattctaggcctaaaacagtttggcaataaaataagaaaaaggggccacatgtggtggctcatgctttaatccccacactttgagaggctgaggcagggggattgcgtgaagccagcctgggcaacataaaatttaaaaattagccagacatggtggcatgtgcctgtgggtncagcaacctgggtggctaagaccgaaggatcacttgagcccaggaagtcaaggctgta

SEQ ID NO: 23 - DNA, 1752 bp, Homo sapiens
  misc_feature (356)..(356): n equals a,t,g, or c
gtcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagcaagctgctcaaccaggtactggtgaacctgccaacctccatcagccagcagaccatcgcagagacagacggggactctgcaggctcagattcattccctgttggcagaacccaccacaggtgntatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagawgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactstctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaataaaaaaaagaaaa

SEQ ID NO: 24 - DNA, 2321 bp, Homo sapiens
  misc_feature (787)..(787): n equals a,t,g, or c
  misc_feature (880)..(880): n equals a,t,g, or c
gtgaaagtgggccttggaaaaakttctgaattaaagaaaagctgcatgtgcacggaatgcagtgtgatacattctctaaagcaacatgttgtaaaattttactgctttcttgttgtgttttatatcttgttttctccaggcttcgtggactcgaccagagaagcaagaggtatagcttacctgaccactagccagtctttagttttgaaagcattacagtttaactcaccattgcagtttaataaccagacatgctaaactaattagtaatttagctaaagaataggtcgatagtggtagacattacttagcaatagtatcatttaggatgagcaagcaagctgtgttgggagtggatgaacaaatccatattatttcctaaaactggatcttattctcttgctggtgctggtaaaatcacatccaggtaattacaccaatagaaataaattgcccccaattcccaggccaggcattttgaaatggtgaaagttttttgactcacatggttgatgtggctctggaccataaagtcacagagttagtgatctaaaaacccactcctccctttcctttccagctcaactcatcttgttgctcacttattttataatgatcagtcttggtaaattatcacatcacgtttcatctcaaaagcaatgcaaatgacatctctcgttggttttcccaaattgctaaacgtatctctgttacttttatagagcatyaaatttatgagattagaatgatgtggtacaaatggttttatgttttttaaagtcagtancatttaacctttgaaatttctctgactcattgcttcagtttggataatgtgggacttartttgaaaactgaarttaagtattaatctttaggntttgattgccacatctcaagamcctacttatgatcatgamtataattttttacccgatttatatgaagtaacatatagtgaaaatgaaaccagtggacttcagatgagattcaaggatctaatctctaaggacttttttaaagttgcctttgccttttatccagatggggctttgatcgtgtaatgctataaatgcagaacatcatgatcctatagattctgtattttaatttggtaaatctatcccttagtctttcmgaaatgataaytattcagaacgtataactcaagtgttcaggtcaaggytatacatatttatatgctgtttaatatttaaaagttgactgcctgtccccaggcactgatcttagtttctgcmcatgaacaggctgccattgtcmaattcarttcmttataaacttccygtgtwtaagactgtcctcccygtcattgggatgactgttaagtgcacagcctcactgagaggcttcccscctgtggcacaggaatcacttagtgctgtcacaggttgggtgctttattgtccaaaagtcatggacccactgggattggggaagagagagaagggttaattatcagccaytcttaagcagctacagatctcattctgcttgccttcatacaactttccttgtcattctcatttagagctggttgaggaggagctgagatttatcagggagcattaaggagatgttaagagaattattattgtaagtggaagtaataggtttactcccatgaaagcagacacctcactctgtttttcagaagtgtccttatcatgagtgtcttactttggacgtaattgactttcaagtgaatgctgcccctagggctcagaagttccattctctcctgtttgtctcatttggagatgaagaccataagtccagatgagtgcaaaagaaggctcaggttatggccaatttcattttgtaagttctaaaagcattagcacttttacctggaaggagggagacaaaaacattttgatgagaagaataattatcattaaccttcatatttttggggaaaaaaggagttttcttgccatcaatatcttttcatacttgcccagagctcatctcctccttctgctgcagcctgggtggtcagcatgactttttgtctggatggctggtaggtggcacaccctgaagttgtgcaggagccatagtaaaagcatttcaggggaagatagtctaatgacactggagtctatctgtgtatcctcaaagggagaactgggcatctggcagataattccatcatcaaatctgtagtgagcctactgcaaaataagaattctctttagaaggctggtctgtggacatcattaaacaggagaaatttccacatggagaaatttcctgaaagaaactagataggaattaaaaaaaaaaaaaaaaaactcgta

SEQ ID NO: 25 - DNA, 843 bp, Homo sapiens
acgagcccacccgtttctgcagatgcccgcatcatggtcctgaggggatgggggctggcctggagcctttcccccgtggtgtgtggctatagcggggacatgaagggggtgtgttggggacgtagtgaccactcccttctaccgtcagagatcctgcttccccctgccccctgcccctcctcggctgtccttcataaccccccacccactccccacctgccatctcctgtgcttgtgcggatccaggaagcacctacctgggcacagagatcatcgctcggtgcctcgcccctacacaagggcgattaacttctctgttatgaactcctacttagtaattctgacatgaaactcccactaggataaaacttggcgcagaacagcaattactgaaaacacatttttaaaaaggttgatgttttgtaagagttcatcctcctccactcctcagcctcctcaaggagacacatatttagatcttctctgtgtgagtctaacttggagactgtgagttgcagtttaaaaggggctctggggccaggtgcggtggcacacacttgtggtctcagctactcaagaggctgagatgtgaggaacgcttgagcccaggagttcaagaccagcctgagcaacatgggtagatgggatctacccaaaacatttaacaataaggctggcatggtggcatatgcctgtggtcccagctacttggaggctgaggcaggagaatcatttaagcctgggagatcgaggctgcagtgaggtatggtttcaactgctgtgctccagcctgggagacagggcaatactgtgtctctaaaaaataaaaaaaaaaaaaaaaaa

SEQ ID NO: 26 - DNA, 1333 bp, Homo sapiens
  misc_feature (411)..(411): n equals a,t,g, or c
  misc_feature (1264)..(1264): n equals a,t,g, or c
  misc_feature (1319)..(1319): n equals a,t,g, or c
cctggaacacttcaacaaccagtatccagccgcagaggtggtgaactttggcacctggttcctcttcagcttccccatatccctcatcatgctggtggtcagctggttctggatgcactggctgttcctgggctgcaattttaaagagacctgctctctgagcaagaagaagaagaccaaaagggaacagttgtcagagaagagsmtccaagaagaatatgaaaaactgggagacattagctacccagaaatggtgactggwtttttcttcatcctgatgaccgtactgtggtttamccgggagcctggctttgtccctggctgggattctttctttgaaaagaaaggctaccgtactgatgccacagtctctgtcttccttggcttcctcctcttcctcattccagcganagaagccctgctttgggaaaaagaatgatggagagaaccaggagcactcactkgggaccgagcccatcatcacgtggaaggacttccagaagaccatgccctgggagattgtcattctggttgggggaggctatgctctggcttctggtagcaagagctctggcctctctacatggattgggaaccagatgttgtccctgagcagcctcccaccgtgggctgtcaccctgctggcatgcatcctcgtgtccattgtcactgagtttgtgagcaacccagcaaccatcaccatcttcctgcccatcctgtgcagcctgtctgaaacgctgcacattaaccccctctacaccctgatcccagtcaccatgtgcatctcctttgcagtgatgctgcctgtgggcaatccccctaatgccatcgtcttcagctatgggcactgccagatcaaagatatggtgaaagctggcctgggagtcaacgttattggactggtgatagtaatggtggccatcaacacctggggagttagcctcttccacctggacacttacccagcatgggcgagggtcagcaacatcactgatcaagcctaacgccaagtgtacaaactggcccaaccacaggagctgccagtatccagcagtatctggaccacaggcaaagaaaaccactaggaccaccaggagcacacaaccccagacccacgccggagggcatccctccaccagaagattccgccacctcaagtgaactgcaggaatcctccaacaaccacaaacacatgcttcgctgttagtgtcttcttcctgccctcagcaccacagctcaagaaaacctaaagtttcaatacaanccataggctcacaaaaaaaaaaaaaaaaaaaaaaaaaaaaaaaaaaaaaaaaaanaaaaaaaaaaaaaa

SEQ ID NO: 27 - DNA, 1382 bp, Homo sapiens
acgagtgcgggcagcagcagccccggcacgmgggagagagacaaagcatggaggacacaacaatgggaggaaaggcggactctcaggaacttcattcttcacgtggtttatggtgattgcattgctgggcgtctggacatctgtacctgtcgtttggtttgatcttgttgttgatgagcagattactagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagcctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttcttttactaagctgatattttttattgtaatttgtttaggtttgtcagataggttcatacaaaattaaaagtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatagggaaattattcatcctaaaaaaaaaaaaaaaaaaa

SEQ ID NO: 28 - DNA, 919 bp, Homo sapiens
ggcacgagtgatgctgctggctgccttcctcgccctgtttcctctccatgactccaggggtttgaagcacacaggagctggacatgtcaattctgtagctcttctcccaataccactgaaggccgtgagcctctctcctgtttccagcctgcaggtgccctgttgctgctcttcattccagcttctcctcacttttctctcagtctcttgagcttggaagccttactgtagcttgtgtctcctccctgggcacttgaggtcaggcttttgcctttttgtcacattgagccacatgcctttgatacacagttgtagcaaagaagggaggtgatgaacttggctcactttcttttctgattcccctccctactcatcctgcactccccaccgaaccccagatatcttatagtcctaaggcttgtagaggattaaggaaaggaattggagatgggttttacttagttcacagaaaagctttctttgggatttttcctcccccttagggctttttaagtctaggtgaagtgaaagttcacacatgtgtttgtttggttgctctgtaattagctactagtttttatccctagaccttctctgctccagtgtcttgttcatgtgtcctgaccccgtgtccttgaattcccactttgctttgggatttaagttattgtatgttgtcaacaatatttaaagatgaaaaagtcctgaaggaaacttaccaggttctttcctttggcttttttttttttttctttcgaggtactgtaaattgttaactagggatgccaagcaggcttggttcaatggctaaacctcttattgtattacagtgtaatgctgatctcagcctggtctcaatgccagagcacacagagacttgaataaaactgttataacgattaaaaaaaaaaaaaaaaaa

SEQ ID NO: 29 - DNA, 751 bp, Homo sapiens
  misc_feature (1)..(1): n equals a,t,g, or c
natcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacag

SEQ ID NO: 30 - DNA, 1313 bp, Homo sapiens
ctgcaggaattcggcacgaggtcttgctgtgttgctaatgttgaactcctggccctaagtgatcctcctgccttacctgggattacaggcatgcaccttgtgtctcactaatagatttgctttctaggtctttcctgtcaggtccaccaatattttagatggatggagcacttgattagatcaggagtcaaaattctattcctgaatctattacttaccagttgtactactttgaatgaatggcttaattttttagtgactttgaattgttccagatataaaatgacaggataggtctagagagttgccttagatgaattaggaaacagtttctgagatagagatgttagtgcagtaggtttattggggagtgttctcaggaatgcctgtggggaagtgaaggatgtggaggaggaagatggactggaattcatttgccagagtcctcagcagatcctaccagcwctagagctgggatggcccttcagagttatcctgatccacaaggggtcagcccctaggcattcataagtcactttgtccagtcattggggttgaccccaggaaaaggtatggtttggggtaagaggactcttcagttgagggtagttcctaggaagctagtgagctatgagttggcatcaggcaacatttccagcaatttggtcaatgagttccccttaaggctggatctgggccacggaccatggcactcactgccatattcacagcgtcgttttcagtgtgaaattctactgtgttaaagtattgtacagtcactgaaatgagagtatttttatatttggctacccatgacatttattctcttctgattatattgtttctctcctgatctagagttttagattgttttgtttgttttgttttgttttcctgtacttttctgtctgttgaggaaaaagagttttattcttctagtatgagagtttctattagtcctcctttttagacagatgaacaccctgtgacaattccttttgtctttttgtggcgtgtaaaaaaaaagaaatccataaatagagtcgttacgcaagtcttcatgagttaatttctctctccagttttcttactactttttccagttttcattttcttcaacagaaagcttcttcttctggctggacacagcgctcacgcctgtagtcccagcactttggaaggctgagggggatgtaatcccagcactttggaaggctgaactcctgagttcaggagttccagaccagcctgggcaacatggcgawactcccaactctacaaaaaatacaaaaaaaaaaaaaaaawactcgtag

SEQ ID NO: 31 - DNA, 1003 bp, Homo sapiens
  misc_feature (990)..(990): n equals a,t,g, or c
  misc_feature (1002)..(1002): n equals a,t,g, or c
aattcggcacgagttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtctttttttttttcttaaatttttttttctttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaaaaaaaaaaaaacccaagggggggcccggtncctttccccctnt

SEQ ID NO: 32 - DNA, 796 bp, Homo sapiens
  misc_feature (748)..(748): n equals a,t,g, or c
tcggcccgagaagaaatgtgacgcactctcaccaagatgctgaagctgacattcatcaataagcagctgtgcatccactaggcatttggtaaatgttaacttatctaccgaggtggtgttttcttagcctcccacctccttgctgtggagcagcttcatgtaccatgatgcatattcagatcattcttaatactcatattttgatagagaggtttttaggttttcttttaaaccaagtttattgagataaactactttggtaggatatggaacttaggaataatggtatgaaactagacagcttttttttttttattacactttaagttctgggatatgtgttcagaacatgcaggtttgttacataggtatacacgtgccatggtggtttgctgcacccatcaacctgtcatctgtattcggtgtttctcctaattctatcccwcccctacccccctgcccccaaaaaggccccagtgtgtgatggtcccctccctgtgtccatgtgttctcattgttcaactcccacttatgagtgagaacatgaggtgtttggttttttcttcctgtgttagtttgctgagaatgatggcttccagcttcatccatgtccctkcaaaggacatgaactcagtccttttttatggctgcatagtatttcgtggtatataagtgccacattttctttatycagtctaycatttgggttggttccaaatctttgctattgtgaatagtgccgcaatanacatacgtgtgcatgtgtctttaaaaaaaaaaaaaaaaaaaactcgag

SEQ ID NO: 33 - DNA, 1256 bp, Homo sapiens
ctatgttccatcattccttcccaaagccaccggaagcattccttctaggaaaggtggagtcggtagtgagaagccggaggtgcccctacagacatacaaggagattgttcactgctgygaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcggagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcaygcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactccttaaaaaaaaaaaaaaaaaactcgag

SEQ ID NO: 34 - DNA, 752 bp, Homo sapiens
actgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttctkgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttawtgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatataaaaaaaaaaaaaaaaactcga

SEQ ID NO: 35 - DNA, 2243 bp, Homo sapiens
  misc_feature (929)..(929): n equals a,t,g, or c
tgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttycggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagnggctgcccctggcacttcagaacctcttcctctacacttttggtgtgcttctgaatctaggtctgcatgctggcggcggctctggcccaggsctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctwtaactgcataagcaataagatcttaataaagtcttctaggctgtagggtggttcctacaaccacagccaaaaaaaaaaaaaaaaaactcgag

SEQ ID NO: 36 - DNA, 670 bp, Homo sapiens
ggcacgagaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaaaaaaaaaaaaaaaaaaaaaa

SEQ ID NO: 37 - DNA, 1624 bp, Homo sapiens
ggcacgaggtcgccgccgcggccgcctggaattgtgggagttgtgtctgccactcggctgccggaggcgaaggtccctgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacrgagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccaaaaaaaaaaaaaaaaaaaaaaaaaaaaa

SEQ ID NO: 38 - DNA, 879 bp, Homo sapiens
gctgcatgctgggcgggaactaggaagcctccccaacctctggccccgtggagccctcagcctcagctgcagtggaggcacctcgggctctggggcaaccaagtgtgacaggtggctgtgcacgggcagaggtcctgtggaagatttcatgtgacgggcagaagaggaggaggaggcaggggaggaagcacatccatgaacagggctgtctgggggcagcctgggtggtcgtgaaataggactcagtggccttgagtcctcatttaggccctgatgttctttagcctgcctggcctttggcaaatcgccagcttcacgcacaacctcatttttcacctttgggtgtgggggtcagagtcgggagagcacctgcaaagccacaatgatccagacacacggcaaggtgggcacattcccatcaggctcctcggggagagcagcgcttctgtgcccgggagcagcgaaggtcacacaggaggacccgcacctcctcgtgtcggtggctccgctggtataatcaggactcacgtggtgttcctcgtgtcgtggcccttattgcagagggagcagcacaggctttcctggaagctcccctcggtcatgtggggtgactccagagarccccaccttgcgagactggaccagtccaagtggcctkgagccacarcggcctkgcagtacctkgggagggggtgatgacaggtgcacacggaggcccatgtggtctgtctggagaatgccggagatgtgaaatatgtaatcctgagtgtggcttctagaaggaaggttcgcaaagctgaatatccactcgtgctgttcccttctcacaggagattcctgtcaacgtccgattctgcctcgaaggcaggaggagtaagg

SEQ ID NO: 39 - DNA, 2761 bp, Homo sapiens
  misc_feature (1006)..(1006): n equals a,t,g, or c
  misc_feature (1376)..(1376): n equals a,t,g, or c
  misc_feature (2211)..(2211): n equals a,t,g, or c
gattaaaatttatttaataataaggggaggaataaaataactatgcatttttttgttgaaagcacaattgtgtctgatactttaattacactatctaatttaacctttcataaatgcccagaatatgagaatatcatccaagatttaaataccaattaccaaaatttacagctatcaaatggaagactcaggtttatgctatgccacgttttctcttctttcctttttgtgatggtgttccaaattgtggagaaagaaaacattctatttgtgattgcttctgctagttacttctgcaaaacaaactactcaaattcagtggtgtgatgcaataaccatttgtcatcctcatatattctggggtcaggggtcaaaaatgcaaagtggggtgacatctcgtggtctacagtaattggggcctctgagaattcctagctatctaggaatgaattaaacgttggacaatgaagttttctgaaagcttctttacgtttggctcctgcatkggtatgacttaaaggctgcgctcaaaataatctcttaaccagagkgtctgaatattgcttcttcatgtaacttgagcttcctcacaacatggaatcatacaggtagcttgcctgagtgttgcagttaatgggtcaatgtattgcctttaataatcttgcctcagaagtcacatagaattactttaatgctgagttggtttaagcaatcacagcctgtctgacttcagggggaagaaacatgatgtctaccctttgatgtgaggacattcaaagtattcgtggctaymttttaaaaaagccacagttatcttctttttaaagagatgccatatccttattatcagcaatagaatcaggatttgaaaatagttcttatgctacatatgcattttttataatcattctttctattataatctttttcagaaagggtgaaggggtaaggattatgtttcatactttgkgaaattctgkgctctataagcatttttattttttgnccataatagattatggtacaaagtaactcaaaactagagtgtataaacataaaaaatacaagttttcatatccaagctgtggataagatattcaaatataaaaaagattgtgaatttgttttaaaaagtcttctaattttgtaaaaagamctaagataattgtccactaatcactcattaaatctcctccttagttctacttccacaaaagctattaccatctatgattaatttggatttcagaggaagaaaatacagtttgaggaaaatggattgttggagcaatctcaatgttaactacataaaatagcttattacttgaaaaatgaggatattgtatgaattttcgcaagtcaattggtagcaaaancgacatttaagtgattgtaaatatgtcatatataaaactatcttgtaaagatgttacagagatattatatgttactagcttctggattcagaaaaataactggaacagatttaagttgggtaattgtagtgtgtctaataattttaatacaaggtaaaaacattttctgttgaaaatcagttttaatattgtttggttttatttatattttgaaaatttaaggattcttgaatattcttaagtaaattgcaatttaatgcaattgtagttatactcagtaatatagttacmcttgattraagccattataaaggaaatgtaatcccatactgattatcttcacatttcttttggttaaagatcagtctatttcattgagataacagttcaggagaaaagttattgactacatgtatctatagtattgtctaagcaacaggagtttagtttgcatgttttttatttttgagagtacatcaacgtaatgaaatgtatttaaaattgtacccatatatacataatgatatatatatatatttatgttttmcagcagtgtttttccttggagatgattcaatcaaattgcaaagrggcacttctaattaattattgggaagtmcaagctaggaytattgttttcctgaacgtttgtgmcttgtagtgatctcttmcagacgtgggggtctggmcacttggaccttaaattggaaatggttaaaaaattgttatccaaagaatgacaatggtttgtttgccaagtctttttgttttgttgtgttttgttttttgagacggaatctgtcaccctgcactccagcctgggtgatagagtganactccgtctcaaaaagaaaaaaaaaaatcaacacctaaaaatttactttcttctagtcaatttatttcgatgtgcatcataaattaataacaaaaggggtagatattttattgagctatggttcctgaatcaaaaccacaatctggaggtttccgtctcttcataaaagaagttaaaactcagtgcatgttgctagacgtcatttaatgatcttcattcttctctgtccagagcatgtgtgaagtattaggccagaaagagagagataaataatcttttcccatgcacccctgctggtcacagaagctggctctttaaagtttgagtaactgtcactttgtcaggcatggttataaagtttccagaaagaactagtaaggagcattaatataagatttccccagatgccaattttgttttctgctatatctcactcctctttgaatttcctcatacaattttccatttaaaatggagaattcagctttcttgatcctataataaacacatttgtctttatttgatacaaaaaaaaaaaaaaagkgcggcc

SEQ ID NO: 40 - DNA, 2849 bp, Homo sapiens
  misc_feature (1)..(1): n equals a,t,g, or c
ngggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaactgattgtcattgctgagttatgctatggtgatactttcacgcgggctataattttatgacaaggcatctgttacttcagctggccataaagtgccctcaacactgctgtgcagaccatcaccaccattcatctccagaattggtactcagtaccaaactgcaaactatagcgattcaaacaacagtgctccccaatttcaccactaccacgagcccatgacatctactatatatcatactgagtctgagaaagcgatgtaaccacaatagacacaaaccagacaatacgaaagaataaatacacgactccaccgaagcaacacaacacccagaagatcaaacaagactatgcgccaccacaccacccaaacagcaggaacaaagagaacctaagaaaaacaccacaaacaagaatctacacaacaaacgcaacatcaacaagatagccaaggatagactacacaaaaagccatagaggaacctcggactggtcaccaagagcagaacaaccgacaacacacaatacagtacaaacaagacaaacgctggacaagcgagtaaaaagatgaagaaaaaacgaagaatcaacaacaggagaagtatatgaaaacaacaccaacgcaagaacacaacagtctgaacgacagagacaaatactaaaacgacaaacgtcagctactattaaccgaaaaa

SEQ ID NO: 41 - DNA, 755 bp, Homo sapiens
  misc_feature (1)..(1): n equals a,t,g, or c
  misc_feature (733)..(734): n equals a,t,g, or c
natttcccgttcagttattccggtgacactatagaaggtacgcctgcaggtaccggtccggaattcccgggtcgacccacgcgtccgaactcctgaaacagtgaggacatctcacagaccagacaggagctggggctctgcatctcacagcggtgcctgtcagacaggaagaagtcccgcagaagtggcgtgtgggtcagggcctgcacgatgcagttcatgaagcatgtgttcccaaggttgatcagcccacgcagacctatggtgcagttcgaggtgatctttctccttttcgggttgtgcttcagcagttcaagctcccgtttggttggttcccaagttgaaaacttctctccaacgccttgcattttccaagcttttcgctgctcctccttggcgattatttccatgtctttgtcatagatgtagtcctggcacagaaaacagtagatgcctccgtacatcagatcaatggccaggttgtgccgcttcgccttcgcatgctcgtgaatatgcttctttgtgaaacagccgaagaagacacagtagaggcaggaatgcagcctgttgaggtggacgccacagacatggcagatacaggacttggccttgcgcttgcgggcctcagccgtgccgctccacacgaagcactggtagatggcccgcaggttctgcttccagttgtccaccttgaagctgcccaggtgcgagcagcccggcggcgctaccgccnnctcggcgtccatggcctcgcc

SEQ ID NO: 42 - DNA, 2089 bp, Homo sapiens
  misc_feature (774)..(774): n equals a,t,g, or c
ggcacgagcccggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaacwcaatcaccaccatctttttacagggctggggaccccattcttacttacttccccaagtggtctgtaataagcttgctgagacaacctgcaggagttggagctgggggactctgtgctgaaagnaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatmaaaaaaaaaaaaaaaaaaaaaaaaaaaaaa

SEQ ID NO: 43 - DNA, 4129 bp, Homo sapiens
ccacgcgtccgctttttctcaggatgaatattttcctggccgactcattgatccttggtacaaataaacttctggaagacccagagagaggaaaacacaggagaaattgagcgatgtacgtacatcaaataccactactcctcagcaaccatccccaggaacctcactttcaatatcacgaagaccatccgtcaggatgagtggcatgccctacacctgcgcagaatgacggctggcttcatgggcatggcggtggccatcatcctctttggctggatcatcggcgtgctgggctgctgctgggaccgaggccttatgcagtacgtggcaggctgctcttcctcatgggagggaaaacagtggaattaaagagtgtctgccccagcccggcagggtgaagtaggatggggaaaacgttctcaccagaccctgggacttctatgctgcagcatcgtgacctgaggggtggatgcagttgccacagctctttgaggcaaaggccccgatgctctgtggacagcctcaggcttgggatggatttggcagtgaggaacttattgtaacagaagaaagtcatccaagatgcctgaggaaagaaaccttcaattgagccagccggctggaaaatgtggccaagaaaaccgcagagaccaatgttcggaggagaaaaccagaaagaggggcctgcctggcccctttgatcctttatggccgattccgtggacattgctgctcctcacgccggcagcctctcttgagtacctcaattgcagtctccagaccctcaccccgcaggcattcctgggtcggtgtcccagtcggtcacagtcatggatcctctgcagagcagtagaaagtcgggaggggcccgtgcccatggtcaggaaaggagcggcaggaggaaagaggagcatgagaactcagaagaaattgtacctactcagatgtggagtgaggatagacgttcccagattcaaaggcatcatgaagtgtcatgacaagatagaaaagactttgggctggccaagaaggaactggataaaattatgagtgaggtacagcaggtgggaacagtgtcactgaaccctatcaacagcagagcatgagaacgtgaattcctgctgctggggaggcaatgaaatgatatgggccttcagatgtctatgaatcctgacccaccgtgggtgccagttttcaagagggcttcccatcaaatattgtgcgcaaaggatggatggatgaaaggaagagtgagccaataaacgagggaacgccgggaaaggcagcctcaagccggtgggccctggcacccccaccgtccctgagcatcgagccggttcccgccccggcccgaactggcccgcgcgcgctcgcagccccgcggcggaacccgagggcggcggcagcggttccttgaacgagccggggaatctggagggagcacacaggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgttttctcaatcctgcagcttgcaaaggaaaagccaggactctatttgaaaaaaatgctgcccgattttacatttatctggcatggatgtgactattgtaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcaaattggcttttctccttctgtatttccataccacttttcagccaagaatcctatcataatgtaatctattatgcccgacatctttttaatcaattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttaaaaaaaaaaaaaaaaaaaaaa

SEQ ID NO: 44 - DNA, 785 bp, Homo sapiens
cttttagaaggtacgcctgcaggtaccggtccggaattcccgggtcgacccacgcgtccgggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaaaaaaaaaaaaaaaaaaaaaagggcggccgc

SEQ ID NO: 45 - DNA, 1458 bp, Homo sapiens
ccacgcgtccgggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggttgcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaaaaaaaaaaaaaaaaaaaaaaaaaaaaaaaaaaaaa

SEQ ID NO: 46 - DNA, 1674 bp, Homo sapiens
  misc_feature (1649)..(1649): n equals a,t,g, or c
  misc_feature (1663)..(1663): n equals a,t,g, or c
  misc_feature (1665)..(1665): n equals a,t,g, or c
caagttggtacgcctgcaggtaccggtccggaattcccgggtcgacccacgcgtccggtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagamaaaaaaaaaaaaaaaaagggcggccgctctagaggatccctcgaggggcccaagcttacgcgtgcatgcgacgtcatagctctntccctatagaagtngnaaagggttc

SEQ ID NO: 47 - DNA, 1503 bp, Homo sapiens
  misc_feature (6)..(6): n equals a,t,g, or c
  misc_feature (18)..(18): n equals a,t,g, or c
  misc_feature (41)..(41): n equals a,t,g, or c
  misc_feature (1501)..(1501): n equals a,t,g, or c
gtggangccgctcctganaactagtgggtcccccgggctgncaggattcggcacgagaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacawwaaaaaaaaaaaaaaaaaaaaaaaaaaaaaaaaaaaaaaaaaaaaaaaaaanaa

SEQ ID NO: 48 - DNA, 1280 bp, Homo sapiens
ggcacgagtataaaggcccctccacccagcctctagcccatttctttctctggcttttgcaggattcctcattctccctgaggtcttaactatcacatcatgcacgttctgccactgctgttatcactgctgctgctgctgctgctgctgtcagctagctttgtgactttcagcacccccacttccagcagaaattctagctgccctgattgtgagagtctgaacaccggtcttccatccctgatgatgtttggtggatctctgctcaaatgggttcagaacacacacggggtggaatcactcttgtcctctgccaaggtgcgcctgcttccaccagccctaggggttctgttcccaagactacaccctggcactctgacccttgtcttccttttaattcccttcctcacagtgtcttcttccacatctgacgttcttagctctttagagtccccaaaactatctgttaccatatttcattattgttaactctaaagattttggcatcaaacaccctgcatttgaatgctagctgtgtcacacatcagatgctttactttggcaaatcatagaactttctgtcaatagggataataatggtacctatattgtaatattgtgagtgttacttggataataaagtacatagcacagtatttggcacatagtaattgctcaacaataccaattgttattattattagactgtgccctctaaattatttgtctacggattatgatctgtataaatgacttatcaattaagaagaccacaggtatgcagagtctcatcactcatacaagactgatgtcaattaactaagagaagtttcgtcactaaccaggagtttcacatcatagttccacactttgcttctactcccaatatggcttgttgacttttcactctctttaccctgttttctttctatggttcccagggctatcacttttctttattttggttaatacatatagctgtacactgacccagtctccatgaaaaatactgtcatatactccctctttccctctttccctaatatcatcatctcatagagatcaaactcacattttctggcaccattattctttttataaaatactttacttttaaatttttacccaactacgtctatgttattttagctagctaagctgctataacaaagagatctaaatacagtggcttaaatataacagaagcatatttttctctcatgtaacagctagaggaatgtgtgtagtccagagcatacaaaccacaagtcattcatgac

SEQ ID NO: 49 - DNA, 742 bp, Homo sapiens
  misc_feature (707)..(707): n equals a,t,g, or c
  misc_feature (724)..(724): n equals a,t,g, or c
  misc_feature (726)..(726): n equals a,t,g, or c
gcgctcgagaatagtgggtcccccggrctgcaggattcggcacgagctcacttcaatycttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttntagcacaaaaaaaaaananaaaaatgaccctcgag

SEQ ID NO: 50 - DNA, 2005 bp, Homo sapiens
ggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgktcatcttaacattggtatcccttccctgacaaagtgttgcaaccaacacgacaggtgctatgaracctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtmcaacataatatgttgtttctctgtagcccgttgagcatatgagtaagtcacatttctattaggactacttmcaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttamcctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatstcttggratgctcakttaattcgcagaccggcttaacggattaaacgccccccccc

SEQ ID NO: 51 - DNA, 1472 bp, Homo sapiens
  misc_feature (1)..(1): n equals a,t,g, or c
ncttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaacttaaaaaa

SEQ ID NO: 52 - DNA, 635 bp, Homo sapiens
gcctaaagagagctcccccaggaccagccctggccaagggattgctgcagccctcatccaccttccaagcactggaaacaaacattggagaccaagtgaggcgtcactcaacagccgtagtaatcagggaaatgacaagttacatactgatatcctttgttttgctgattggagttgggtgcattgaaaaagatcagtcgtgcccagtgtttgggggaaggaagcgtcttcacctgttgtttgtgggaggacagttgaggcaggtgaggatgctgagaggtgagctcagctgtgcctgttaccgtccacatgtgcaagcccttcagctcggtggttgtacttgtttttgagatgcagtttcactcttgtcacccaggctggagtgcatggcatgatcttggctcgctgcaacatccgcctcccgggttcaagcgattctcctgtctctactaaaaatacaaaaattagctgggtgtggtggtgcgtgcctttaatcccagctactcagaaggctgaggtgcaagaattgcttgaacctgggaggtggaggttgccgtgggccgagatcacgccaccgcactccagcctaggcaacagagctagactgtctcaaaaaaaaaaaaatgaccctcgag

SEQ ID NO: 53 - DNA, 1153 bp, Homo sapiens
ggattaaggtgtggtccctggaccatgcccaacggcataggcagcacttgaaaactggctaaaaacgcagactctcaggccccgggccagagctactgaatcaaaatctgcatgawcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttraaaaaaaaaaaaaaaaaaaaaaaaaaaaaaaaaaaatgaccctcga

SEQ ID NO: 54 - DNA, 729 bp, Homo sapiens
ggcacgagcaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtaaaaaaaaaaaaaaaaaaaaaaaa

SEQ ID NO: 55 - DNA, 1079 bp, Homo sapiens
ggcacgagccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaaaaaaaaaaaaaaaaaaaaaaaaaaaaaaaaaaaaaaaaaa

SEQ ID NO: 56 - DNA, 1959 bp, Homo sapiens
ttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcggcctattaaacctttgttacctattgtttccttaacacaaaacgatcacacaccacaacacacgcaacccagacacaaacaaccaacaccagagcgcgccacacaacacacacgagggaggcgacgtgaaaaagataactacacagagaggcgcacacagatcacagtaatagaaacatatattattataaaaggtgcacccataagacgatgcgtcactataataaacctacacgacagaacagccagcacgccattgtacaacagccgacgccaccagcagcggaccaaaacaactccatcagctggactcactgcgttggaaaggaggaagccaccaaccctcgcgtgagcgcagctacacccactgggacccaacacccaccgcacagagttaaccacgccgccgtgacattctacacgaacaccgacgcgtcttgggtatccacaaacccagtataatgagcagcagagaaaaacgcatgatgacgactgattagattcagcgcgccgcaacgtaatgacg

SEQ ID NO: 57 - DNA, 812 bp, Homo sapiens
  misc_feature (17)..(17): n equals a,t,g, or c
  misc_feature (108)..(108): n equals a,t,g, or c
gaccatttttagccaancttggaattaaccctcacttaagggaacaaaagctggagcttccaccgcgttggcggccgctctagaactagtggatcccccgggctgcangaattcggccacgagaggacttccccacctcatgcagctatttgggccgtggcgtctgaaatttattatttcagagtcacccctttratgaccttggcagtgractgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaagctctggaagtcaaccgggcgtggtggctatgcctataatcccagcattttgggatgccggggcgggtggatcacctgaggtcaggagttcgggaccagcctggccaacatggcgaaaccccgtctctaatacaagtgcaaaaattggccaggcgtggtggtcactgtgctccagcctgggtgacagagcgagctccgtctcaaaaaaaaaaaaaaaaaaaactcgag

SEQ ID NO: 58 - DNA, 1756 bp, Homo sapiens
ggcacgagttttcctctcacatatatattgttttgtgtccctggctaaagtacaagctttttgaaggcagaaaccatgtctttggtttcttttgtatttcccatagcaccttttactgtgagagtgggcacacagtatatgttgtggaatgacatcctgagtgatccctccctggctgggcctcagattaaattccctgaaatggaacagtcctaaccaacacaggacaggtattctccatctggcatgttggttgctcctttcaacctgctatttgaaatggctcccttcaacatctttctgttcccacagtggggcttgctatggctaatgctgtacttgctgtatgtgttccaggcgagtctgcggacaccagaactgacctgggagcgagtgagatctcaagttgaccagtgatatggcctgatggcaagaggatagtactgctggcagaggtaagctgagactggcaaaaatactcccccacaacaggagagactgcaatacccaggtcccctcctcctcatgttctcgaatactttcaactcctctgttaagcacaagtttgactactttcccaatggattttacttctaattgtgaaagatcttttcattcagcaattaagaaactattttggttccccacttttcaccaattatcctgtctctccacgtcaatccacaggttgagttagataattattactatagaaggaattcacagatagaaccagtgccactttgagtgatgcatacaaagagataatgtcacttgtgggatgttttaatcactaagcacaaagtagatatgcccgactgtaaccaggactatcttaggcaagttctgggaatgtatgtttttactgatagattccctgtttttgaagtccattcccttgaattgagccagatgagtataggtacctacctagatatcaattgctcaattgatatttccccatcctagctcctagctcacattgacactattgactttcattttattggcttccatgtcagtgtttgaccacttttcctttcttaaaagctcctcttccctagtcctggattcctgacagctataatattagatgccttctattcttaccttgaagctttctcttcttcagagaaagataccaaaatatcaaggaggataataatacttttctcaattttgattttcagttggttttttttctttttttatattaaagaacctgaatatgaaaatgtaaaatatacattgtctttatctaggggcccataagttaggagtttttagtgtccttactgtttcttcacattttcctcactttatctcatcttctcagatacttcagggcatttgtaaagggactgaactatttcttcacaaggaaggagtatatatgaggaggagatgggcagattgccaaatatgcattaatagctttgatgtcagtctgctgactgatgacttgtttctagctgccctaggaggtcccacctggtaattttggtgacaaaagcaagtaccatgggtgtttttggctagatggttgagcaaaaaggtggtcaggcttcataggaaacaaaataggaaagggtggcattgggggcaatttctagttcttctactgtctgaatcaccaactcaaaatacaaggctgacaatgctgtctttgaattcaggagaagcaaactgaaggagaagcacaaaaatcatcacagctatggtgaaaccctgtctctacaaaaaaaaaaaaaaaaaa

SEQ ID NO: 59 - DNA, 2098 bp, Homo sapiens
ggcacgagggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaacaaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatctaaaaaaaaaaaaaaaaaaaaaa

SEQ ID NO: 60 - DNA, 2325 bp, Homo sapiens
ggcacgagaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaaggtgagtcacaagctcacatacaaacactgtggaagcagagctcatgattatttagagggagaatccttgctttgaaaaaatcactgaagtgactaatgaaccaagcctccatgtcttagccacagagtgatgtaccaggcgagtcacagtagagcatgagtcatcggtggtggaggccttttccactcgattccctttttatttctctctctagggttgtagtggttcctttagatcaggatgaaaaagcctgcctgagtcaccatcactaactcaattgcctactattctgagggggcggatagagttcctgggatattcccgggaataccttcttaaagctgtattctctcaaagccaaaatcagtggagttggatgaagcaagacctcttcctctggtttttcactttttactgggagaatggctgttatataaagtgattataagatgtcaaaccaacccttggaggaaaaggcaatgtccactcgccccatctttgttccagtttgaattggttctgctagtacatgccgaatgtcttcattttgattgagaaatatgttgtagatttctgttatctgaaatagcatgaagtgtagaattgtaattaagctgtttcttccttggaaaaatctgaatgatgtctaggccttcaaagaaaagctgctaaaaagatttgggcttgcatcctgagctagctcgatcatttgctgaatttagggcatcgtagtcatctttttttctgcaaaataactatgagtttggaagagacccagaggaatcacagctttgaaaagggaagacccaaggaccctacttctgttaggaaacctctatgacctactccaggcagggattacagcttatgtttattgagtatatagtaagtgccaggaacttagtaagtgttaactcatttaactttgatagcctcccaccattgtacagatgaggaaactgaggttaggaatccatttgttgagcatctacagggactagttaagaaacagtttctcagcaaagctccttgtaatcccattttatatacactattttgtgtattttaattgttttattttagtaacacttccctttaaaatcttcaaactgcctattgttaggtgccagtgggagtggacccctgatggtcagatatataaatggcagtggttagaccagaccagaaccctagaagatggtagagttggggcaaagtagaacccaggagggattaaatttgggccatcaccttaatcctagttttgacatctgcaggtaacatggtattggttcagaatagtaaatctatccattaaaaaagaaacacttataaaccacagaggtattgtaaaaggaatttttaattatgttgatgaaaaccatatcaaaagagataatggttgcaaaatcattttacagcataaagtcttagagtcaaagagtcacagaaatccagtgcattaaattaattgacagtaacttccctcctttgacagatgaaaaaatagaggcccaaagagatggagtgctatgaagctatacagttagtaaataatacaaaaccaagaagctgggaacttcactgctatctctgtagacctgacagccatgatcacagctggagcattacataaaggcaatgcaaaaaaggagagtccatccattcaataggcattcatttagtcaagcgtctcaaggatgagttggatccttgccttttaagaaatcaagttgaagctgggcgcagtggttcacgcctataatcccagcactttgggaggctgaggtgggtgaatcacttgaggccaggaattcaagaccagcctggtcaacatggcaagacctcatctctactaaaagtacaaaaacattagctgggcgtggtggcacacagctataatcccagctactcaggtggcttaggcacaagaatcacttgaaccctgggaggcattggtcgcagtgagccaagatagtgccactgcactccagcctgggcaacagagcgagaccctgtctcaaaaaaaaaaaaaaaaaaaaaaaaaaaaaaaaaaaaaaaaaa

SEQ ID NO: 61 - DNA, 1675 bp, Homo sapiens
cttaaagacgccaggtagagacacacagaacgtatgtattaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaaaact

SEQ ID NO: 62 - DNA, 910 bp, Homo sapiens
ggcagagctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctgaaaaaaaaaaaaaaaaaaaaaaactygrgggggggcccggaacccaattcsccggatagtgagt

SEQ ID NO: 63 - DNA, 1280 bp, Homo sapiens
gggcagacttaactgctgtctgctcagcatggaagccaggagccaaaccagtgggcttgatgacagtgagctatttctggtggctcagggttggggcttgggccgaagatgtggaggccctggcttcccttcctgaggacagactgaggtggaaccttttggctctgccagcttctccatgtgcagtcacagcactggtggcaaggcataggagagctgggctacaaagaagcattcagtgtctcctggggcggcagggaggtgggggttgtaattgtgaactcaccaaaccccaggtgggcagtaagtgggtgggtcataggaagaaaagtgatcttcagtcaggagacttgggttctgggctctgtctgatgactggctctgtgatgtgagccaggtgacttctctaaccctgagttgcctcatctgtaaagataattccagtcttggaggatttttatggasyaaaaaggacagagcggtcctgtgtatcccctgcaaatggttagacgttatccatttacagcccctgccaagccaccactagcttcttcagagaacttttgaaccctgcctccctaaagtagttctaaaacatttttcactgtgttacccatcaagggaaacaaaatgtttctacaaaccatagtaaataggatcgtttttgtattgtgtttcaaggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagaaaaaaaaaaaaaaaaaaaaaaaaaaaaaaaaaammmagggsggcccgggaaccaattt

SEQ ID NO: 64 - DNA, 953 bp, Homo sapiens
ctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctkgagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaaaaaaaaamaaaaaagggcggccgctctagaggatccaagcttacgtacgcgtgcatgc

SEQ ID NO: 65 - DNA, 821 bp, Homo sapiens
gttttgagtgtgtgaattacatatatgaacatctgaraaaatcctataagcagtttaatcaactgttccactccactccaagtgagtccataggcagaattgagttatggggagagcggcctagtaataattggtttgcgtaatacaaagttctactgggtagtgatgttgtagaagttcatatagaatcagctgagctttcagaaatggtgaaagggtggtaatagtcataacttagattgtaatttttttcccataggcttttaaaaaatattcatgaggttctttttttatttcaatagtttttggggaacaggtggtttttggttacatgataagttcttcagtggtgatttctgagattttggtgcacctgtcatgtgagcagtatgaactctactttatgtgtagtcttatccctcatgtgtatgaactccaccttatgtgtagtcttatccctcacccactcctgcccttccccacaagtccccaaagtccattatatgatctttatgcctttacatcttcacagtttagctctcacacaacttattataatttataagtaagccagcattggatatagttgtattccattattaatttaagaaaccttatgcaagtaattattagtcatcatcccaaaaaaaagggagaacagggttagattcagaatactttgataagagctaaatactatcatgagtgctgtcagtctgtagtaactttccattggtattctatgtcttttaggcttacagatactttttacactcttacaaaatgtgcacaagaagaagctgcagctcagagctcgtgcc

SEQ ID NO: 66 - DNA, 1027 bp, Homo sapiens
gtccgcccacgcgtccgtacaatgtatggtgtgtgtttgtgtgtataggttttgataaattttaacttttttaaatagatttatgtatggtagtaaatgatagactagtatctacatgtattttatgtactcttcacatacctttattttttttgatatttctagtctatgaggttcatctggtttttcaaattgttgcaaatctccaaaaaattttccaatacatttattgaaaaaaaatccatgtataagtggacccacacagttcaaacccaagttgttcaaggattgactatttgtctatctaaacatacctaaacatagraaaggtacagtaaaaatacagtattataatcttatgggatcaccattgtctatgcaggctgacattgaaatgtcattatgtacagcatgactgtatagtgtttccgagttctgtgaggctctctagcaaactaatggagctcaagaaggggttatgggaaccctaacttatagctagttggttaggacccttggtcaccatctggggcttctgattgtcatctgaagtgggagccatcttgtggcactgagcyttcaacctatggtatctgatgctatctccggtagtgtaagaagtgaattgaattagaggacacccagctggtgtctgctgcaaaattgcttatttgcttaatgcgtggggaacccccctccacacacatctggagtcagaaagggtgttgtgagattaaagtgggagaaactgaatttgtttattcctatattcagaatggggtccttgaraacatcatagtggtaagcatagatgttctaaagtcagactgcctgggttcatctctctgctccaccacttcgagagttactttagctcactgtgcttcagtttcctattaaattgggataataataccatctcatagagtaacttaagaattaaatcagttaatatacataaagcacttggaagtgtttgaagcattaataaacactcaatagctaaaaaaaaaaaaaaagggcggcc

SEQ ID NO: 67 - DNA, 1368 bp, Homo sapiens
ctggccctcgccttcaagctggacgaggtggccgccgtggcggtgctcctgtgtggctgctgtcccggcggcaatctctccaatcttatgtccctgctggttgacggcgacatgaacctcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtttccctgtggtctctgctagtgactctggtggtccttttcataatgaccggcactatgttaggacctgaactgctggcaagtatccctgcagctgtttatgtgatagcaatttttatgcctttggcaggctacgcttcaggttatggtttagctactctcttccatcttccacccaactgcaagaggactgtatgtctggaaacaggtagtcagaatgtgcagctctgtacagccattctaaaactggcctttccaccgcaattcataggaagcatgtacatgtttcctttgctgtatgcacttttccagtctgcagaagcggggatttttgttttaatctataaaatgtatggaagatgaaatgttgcacaagcgagatcctctagatgaagatgaagatacagatatttcttataaaaaactaaaagaagaggaaatggcagacacttcctatggcacagtgaaagcagaaaatataataatgatggaaaccgctcagacttctctctaaatgtggagatacacaggagcttctatcttgctgaaatattgcttcatatttatagcctgtggtagtgcacatggttaacataaaagataacactggttcacatcatacatgtaacaattctgatctttttaaggttcactggtgtattaaccaaacgttgtcacaaattacaaatcaatgctgtaatataatttgcacctggaatggctaacgtgaagcctgaattaaatgtggtttttagtttttaccatcaccaatttctatgactgttgcaaatacagaatctattagaaaacagggtcttggaaatgtagaattttggcgcactatgaggaaaaacaagctatctttgtaaagcataattgagtttaatgtaattgttgtaaaaaaaaaagtgtgcttgctctacttaaaattcctcacaatgttgaattttgacctgtattcagaagaattccaaaacaggtcagttaaataaggaaatatagtatttgtcaaaccagtatcagagaaaagttaca

SEQ ID NO: 68 - DNA, 981 bp, Homo sapiens
acggaagcgcagagcacggaccccgccccctcgcggccccgctcgtgacgtcgcggggggcgccggcctccgcccggccccgagggcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccaaaa

SEQ ID NO: 69 - DNA, 864 bp, Homo sapiens
  misc_feature (28)..(28): n equals a,t,g, or c
  misc_feature (706)..(706): n equals a,t,g, or c
  misc_feature (745)..(745): n equals a,t,g, or c
  misc_feature (748)..(748): n equals a,t,g, or c
  misc_feature (757)..(757): n equals a,t,g, or c
  misc_feature (765)..(765): n equals a,t,g, or c
  misc_feature (772)..(772): n equals a,t,g, or c
  misc_feature (781)..(781): n equals a,t,g, or c
  misc_feature (813)..(813): n equals a,t,g, or c
  misc_feature (840)..(840): n equals a,t,g, or c
  misc_feature (842)..(842): n equals a,t,g, or c
gagaagacgacagaagggtacggctgcnagaagacgacagaaggggaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggtatgccggaatcattggaggtgagtccatcagaaacaggagctgacaacctgctgggcaccccgaagancaaagccccctggcagcttaccgggcccaagcctctggnatncccttgaanagcctggncagagangggaagacnccgatgatgaacttggacccagggttgccggncccagggctcctacttccccaaacctngnccggcccttgaaggttacctgg

SEQ ID NO: 70 - DNA, 786 bp, Homo sapiens
ggcacagcggcacgagaagactttggtgtttaagagattaatgtgttagccagaacaactcatttctctaccmgtgtgtagtccatttatctttaaagattttctattggaataattttgaaattactttcttagttttcttcattaaaaactaagaaaatgctttgtttattatgaattgctatttctcttgattattattcttggagaaagtctatcagacgtaattcttctgatttgcttctaggctagaggaaaatgtgaaagatgacaaatgaaaatttcaaaggttgtcagtagtatgacttcttttatcgtttgtcattatcacaaatatatcaacataggacttttaaaagatattttgtacatattgggccttagtaggattttgcatgaattttttttttcttttatgcccagagagaaagagcaaagaaataaccaagggtgatgtactcgtattgaaggtttaccaaataaggactgcttttattatgaactatagtctatattctaagtaaatcaatttttctattatgtgttttttgttcctgcaggcaagatctctgaactttatgcagagggttcttttaaaaaaacaaagttgaatttttttatttcttggaatattttttttcattgatttctcccaagtagagcagattcaaatctcctttgtaccctatgtcttttttgttttgctattagctcagtattccgtttctacattttcctttcctagaaccagtcaataaatgacaaaaaaaaaaaaaaaaaactcga

SEQ ID NO: 71 - DNA, 1175 bp, Homo sapiens
gagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctytctgcaatcaataaacacttgcctgtgaaaaaaaaaaaaaaaaaaaaaaaaaaaaaaaaaa

SEQ ID NO: 72 - DNA, 1038 bp, Homo sapiens
  misc_feature (2)..(2): n equals a,t,g, or c
gnaattcggcacgagttaatgtataaaatatttctataatgaattttaatgggaattagagcatcatagaaaaaatgctcttactgttgaaaacattatttgttacattttggtcaactaatctttcaataacttttagtaactataatgttaagttgtaccagtggcagtcttatatagtaaatggcagctgacagcatgaaaataacatatctaatattttgtgactatcttattaggaaaatcagagaatttcaaaaccttgttagtttttagggtatagtcacattttataaatgtgcggtatatttatacatgatttgacgtttgtgwaaatattttccctggacttttattttagatgagatctacagtgtaggcaaacttatataatctgtcaactccattagtgtcatagtcagactcatccccatgctaaaattatagttgtkaaaatacgcttttgtaaatagttgtgttaggtcattatcaccaagtcttcaaggkattacattataaaaaccttggkttttattcttgtgaatamccgttttttccatgcaaagttaaaattcttcagcctttaatttttttattaatatataaggatgtgatgagtatgactacaaaacaggaaaaaataaacagatttcgtttgtggcttttgctaaattgttacctgacaaaatcttagccagttcttcattttcgttttgagatgaagatacttagttttagtccaggggctgggcgcgatagctgatgcctgtggtcccagtgctttgcggggccgaggcaggtggatcacttaaggtcaggagtttgagaccagcctgcccaacatggtgaaacgttgtctctactaaaaatacaaaaattagacaggcgtggtggcacacatctgtaattccagctactcaggaggctaacacaggaaaattccttgaacctgggaggcagaggttgcagtgagccattgcactccagcctgggcaacacagtgagactcttgtctcaaaaaaaaaaaaaaaaactcga

SEQ ID NO: 73 - DNA, 1404 bp, Homo sapiens
tacgagtttttttttttttttttttttaaaggagagggtgcaatgatgctccctagctagtaagagtcccatcttggccttctaagggaaagataggtaaatgaaaagactgctaaatccaaggtcagacagcatatagaaggctttataaaagaacaggaaaactcagaacactaaataagagagtgctttcttggactctgcagttggcctcaatcatcggatctggaatattactttttacgattttgsaagccgatacacacctgtaagtaataactgaggaaggtagagtatgattagtctttttacctttcagtgtgtatcaatgttaagtgaacaagagcmaaaggaaaaccatatatttagtattttgcaacatatataaaataacaacactgggctgggcgtggtggytcaagcctgtawtcccagcayttkgggagccgaggcagggggatcacaagktcaggagtttgagaccagcctgsccaacatagtgaaaccccgtttccactcaaaatacmaaaaattagtcgggcgtggtgatgggcacctgtaatcccagctactcgggaggctgaggcatgatgatcgcttgaacctgggaggcagaggttgtcgtgagccgagattttgccactgcacaccagcccgggaaacagtgcgagactccgtcttaacatgaaaaacatgaacagccgctactatctgagggcaattttttgtctttatactttggcatgtatattatttctacaaataattttaaaggccaggtgcggtggctcacgcctgtaatctcagcactttgggaggccgaggtgggcggatcacgaggtcaggagatcgagaccatcctggccaacacagtgaaaccctgtctccactaaaaaacacaaaaaattasccaggtgtttggtggcgggcacctgcagtcccagctastcaggagtctgaggcaggagaatggcatgaacccgggaggcggagcttgcagtgagccaagatggcgccactgagctccagcctgggcaacagagcgagactatgtctcaaaatagtaataataataattttaaaataagggggaaaaaatcactgataaaccaaaaacctcaaccttaagaaacgttcacatctgtatagctaatactctgacgatggggatacaaaaacaccttcactcagtggtcttgcagatatcatttttttcccagtattttttggaaagaaccaatctttgtctttttttctccttcttcagggaactttatgaatccagaaagagccaacgtttgaatgattactgcaatctcacatctattaaatcctgatacctgcaaccaagagatgagtaggagatgtggatcctaagaggtgacctgtaacatactgccccct

SEQ ID NO: 74 - DNA, 843 bp, Homo sapiens
ggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggccaagtgtttaatgcctgacatctcctcctgtcctgggcctggaacctgcagctgagaaaatccctcaaccacctcgtctcctccatcgcccctgctgggccccccagcctgacagtgggttg

SEQ ID NO: 75 - DNA, 849 bp, Homo sapiens
gaattcggcacgaggtataatgccattctcttcctctgtgaagtgcctgttcggggtgttgctacgtttttgttttgttgtgttttctgttgtagtgtttacatttttcttgtcgattcctaagaggactttagggtactgagtcacccatggtcatgtgttgcagagaagtgtcacagagtgaaaactgtcttttccttgatactacctttagattcatatttgggaagaccttcactaatcatgactacataagtattcacttttactttcttaaggcctttttgttttcattcttttatagtaatgtctaagccatctggaattagtttgttgattatgcaagaaagggatcgaagtgctttttctgagtcattatccacatgccgaaacatttattgaatagccctttccttattgatctgaaaacaccttcttataaaaccttgcattggtttttggacttgctgtgctttcaggagtcagaagaacattcttttgattatkgtagctttacatwaataatacatttkggccgggtgcggtggctcacgtatgtaatcctagcattttgggagactgaggcaggcggaacacctgaggtcaggggttcaagaccagactggccaacatggcaaaaccccgtctctacaaaaaaaaaaaaaaaaaaaattagctgggcatggtggtgcctgcctgaaatcccagctactttgggaggctgaggcaggagaacctcttgagcctgggaggtagaggctgcagtgagccgagcttgcaccactgcactccaacttgggtaacagagtgagactccatctcaaaaaaaaaaaaaaaaaaaaaactcga

SEQ ID NO: 76 - DNA, 2434 bp, Homo sapiens
  misc_feature (10)..(10): n equals a,t,g, or c
  misc_feature (12)..(12): n equals a,t,g, or c
  misc_feature (27)..(27): n equals a,t,g, or c
  misc_feature (73)..(73): n equals a,t,g, or c
  misc_feature (75)..(75): n equals a,t,g, or c
  misc_feature (103)..(103): n equals a,t,g, or c
  misc_feature (130)..(130): n equals a,t,g, or c
ctgggggtantncaagaaccctctgtnggacttagatgtcaagctctttcctttgggcagcgtgtttcctttntncgagtagtgtgctgtgtaaactaaattngccggttcgctttccatttcctgacanttgagatggaatgccttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacataaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 77 - DNA, 872 bp, Homo sapiens
  misc_feature (844)..(844): n equals a,t,g, or c
  misc_feature (858)..(858): n equals a,t,g, or c
ggggaagttcttcactgccttgcatttgactccagatccctccatcctcccagagccttggcctcaaaaatgctgattctagcatcatggaaatgctgtcctcaaagtggtctaaacgggttgctgcttcacttgctcacttaatctcccttttcatagggctgttgtttttacttctgggaagttctgtttaccctggaacagaaactctcttccctaaaagttgattttattgacccatggaggccagagacacttaggcatattttccctccagactagaagcttctgaggaggacctcctgagtctgcaccctggctccctgctgtgctgagggcccccgtgttaacctcacgttgtgcctcctctgattcagagggcccagtgtggttctgtcagccaggcagtggccccagctctacagaaatgagttgtcattgcatcctagggccagggtcttcgtgcttgtgtgtgttacgtggaagtatgtggacaccaagtgttcctggatggccacagcctgcgaaggaaactggggccagcagctgctctgtgttttcagccaacaatggctcctgcccactgccgctgcataaccaccagaggcaggcttctcttgacacaggcctgtcgttggagcatgtgcctggcgagtcctatttctattcccctgtgggttagggacaggcagctgtaccttcagtgtgttgctggggcaggagaatcgcttgaaccgggaggcggaggttgcagtgagccaaaattgcaccactgcactgcagtctgcaggacagagagaggctmtatctcaaaaaaaaaaaaaaaaaaaactcgagggggggnccgggacccaattngccatataggaaaa

SEQ ID NO: 78 - DNA, 1932 bp, Homo sapiens
  misc_feature (2)..(2): n equals a,t,g, or c
  misc_feature (1022)..(1022): n equals a,t,g, or c
cncggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaancagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctascagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctggaaaaaaaaaaaaaaagggcggccgc

SEQ ID NO: 79 - DNA, 1853 bp, Homo sapiens
  misc_feature (1840)..(1840): n equals a,t,g, or c
  misc_feature (1851)..(1851): n equals a,t,g, or c
ctgcaggaattcggcacgagcacctataaagaatctcaacccacttcccactcaaaagcactgtgtatttctcatggcctgcctgggagcccccatctccagcctgctgtgctggctacttctggcacttatagcccttgagatagtaccgccagcagctccctgtgaagtgctaacaccccttcaaagcagcaccaacccaattgtgaacaagctaggagtaaaagacgtaaatgaattggtcaccccaatgcaggggatacagacttgttttaatataaaaaagaagtggccttaaccgtgcagggcttgcaggcctttgtaggcatgggagcatgctgtgatccctggttctgtgctaaacactcaaaagggctctctgactcaagtggaggtgataaaccttttcaatagtaacaggagagagtgtgatatcaaagtgccmgaasycctcacggaccaacatttagcacagacattcaaactgctgaaagawccaawcagaactcaactgaaaaaaacagaccttttaagaaaagcaatagatcttaatttggtggcaagatccctggtttaccttttgaagtcaaaatgttcaatacatcacccgagcttgacttttgagcacttggcaagattgttttttgccacttgacacaagtatgatgtccagctatgcaaaatgactgtttgatctgccttttcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccttatggtgctaaaacctcaaagctgaggagggctgcaggacccttagcagattcagtgtgtcacccttgtcctgtgttcacgccaaggcttcctaaatgaaagacatcggttacctgcttatgggaagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaaaaaaaaaaaaaaaaactcgagggggggcccggrcccaattcgccanatggagatccnaa

SEQ ID NO: 80 - DNA, 1061 bp, Homo sapiens
ggcacgaggattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaaaaaaaaaaaaaaaaaaaaaaaaaaaaaaaaaaaaaaaaaaa

SEQ ID NO: 81 - DNA, 601 bp, Homo sapiens
gctgccaggaattccggcacggggaacagtgtaatattgaagcaaatgctgtataacaaccacctggaagcccctcatgtatctctttttgaaaacactcctctctttctccactctaatgatgaccaccgccttgtcttttatggtaatcactgttctttgggttttattactgcatttattggctaatatatgcatccctagaaaatgtagttttgcctgcttttatataaatggaatattactgcatgcagtcttttgatttgtgattgttttgctctaaggcttgtaagggtcatccatgttttgcatatagtttgtttattgtcattgccatagagtaaatcattgtatgaatatactgcagtttatttactgttgacatatgtttcagttgtttttaactactaggaaatgctactctgtacattcttgtatatgtaccttggtgcacatatgtatgtttttctagagtatatacagtggcatgggattgctgaattaaaaggtttgtatatcttatactagaagataataaaaacttttcctgatggattctgccaattcaaaaaaaaaaaaaaaaaaaaaaaaaaaaactcga

SEQ ID NO: 82 - DNA, 1356 bp, Homo sapiens
ccacgcgtccgcttcacagtttcaccttcaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggacggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcctctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgaaaaaaaaaaaaaaaaaaaaaaaaaaaaaaaaaaaaaaaaaaaa

SEQ ID NO: 83 - DNA, 1411 bp, Homo sapiens
  misc_feature (1395)..(1395): n equals a,t,g, or c
  misc_feature (1397)..(1397): n equals a,t,g, or c
  misc_feature (1401)..(1401): n equals a,t,g, or c
  misc_feature (1408)..(1408): n equals a,t,g, or c
ccggtccggaattcccgggtcgacccacgcgtccggcgtgaaccaccgtgcctggccggaagtctttaaaaaataaagtgattctactcttctaagcttacagagaccagaccaggtgaatgtaactggggaaaatcaagatggtacctctctgcattatcccgccagacactgtattttatgcattcatgtctaggatacagtgtgaaaattaaaaagtttagagggcagatgcaattgtggcaagtgacctgccaataaagcaggtgcagctatagaagctggcataggtatatccttaatggtgctttctccctgggcttgtctttttgttgtttttttcccctatattcagagctccttgagaagtgataaacacctccagctttctaacatcctccccacaccatctcaccatatccatctcccagcatccatctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacmacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggttttaaaaattcaaaaaaaaaaaaaaaaaaaaaaagggsggccsctytaraggatccaascttgcgtacgcgtgcaacganancagngtcgagnggt

SEQ ID NO: 84 - DNA, 1554 bp, Homo sapiens
  misc_feature (695)..(695): n equals a,t,g, or c
  misc_feature (874)..(874): n equals a,t,g, or c
  misc_feature (1190)..(1190): n equals a,t,g, or c
gctttaatagtgtacacttacacatctggaaggaagagagttccatatggcagggatgattgggacaggagggatcttttgataactttgtgtgagcatgaaaatcgaatggggaagggagagctgtgaaaaaaaaatgttatctctttttttttgcttctggaaacccagctttttggtcagccgtcttgtgatttggctgggcctggtttgtgggggtcgctctctgagttgggtagctcttggagaagattatctgggaactcccatccttatcccaaacatacaccaaacctgcccccatccaccattatgggaattagtaccagagcatccttgcagattagttctcattttctctctttgtgagcacacacacatcaggtagagttccagaaacccagctttaggacactgttcacatatcacaggaggagcaaggacatgaatacaagagagctctttcctgaccagcagtgggargtggttgtactatctatttawttgtttattwatttatttattttttgagatggartctccttctgtcacccaggctggagtgcagtggcatgatctcggctcactgcaatctctgcctcctgggttcaagcagtcctcctgcctcagccccccaagtagctgsgattacaggctgcaccaccatgccccgctaatttttgtatttttagtanagatggggtttcaccatgttggccaggctggtctgtaactcctgamctcaggtgatccacctgccttagcctcccaaggtgctgggattacaggtgtgagccaccgtgcccggsctggttccactatttattaaaatgtatatatgtgttttycacttttttggtaggcattttattgntaataatttggaaattaaaaaaatttctccacaagcttattttttgtggagacaaggtctccctgtgttgcctaggctggtcttgaattcctgggctaagtgattggtctgccttggcctctcaaagtgctggggattacaggcataagtcaccatgccctgtttgscagcaagktttawackgctctttttggtagggawwtkctmaggtwcagtgatagagaacatgkagttgtggtgggawacagtggctyatgactgtatccgcactttgggaggctgaggcaggaggattgcttgaggctgagagttgagnacaggcctgggcaacatagcaagacaccttctctaaaatgaaaaaaattagctggatgtggtgtcatgtacctgtagtcccagttgcttgggaggctgaggcaggaggatcacttgagcctgggtgttcaagataggcctggtcaacacagcaagaccccttctctaaaaatgaaaataaaaaaattagctggttgtggtggcatgtacctgtagtcccagttacttgggaggctgagacaggaggattgcttgagccaggggtttgaggctgcagtgagctatgactgctcccctgcaccccaggctgggtgacagagtgagacccagtctctaaaataaaaaaaaaaaaaaaaaaactcgta

SEQ ID NO: 85 - DNA, 2083 bp, Homo sapiens
ggcacgagcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccaaattcattgattactgaaaattgaatgttttttgggtccacatttcaaggctgaagtgtgtagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaacttcatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggctgtatagatatgtatatatggttcacacatctggatctgtgtatttgattttgtactttaaatgtgacaaataaaccttttgggagaaaaaaaaaaaaaaaaaa

SEQ ID NO: 86 - DNA, 730 bp, Homo sapiens
gggagaacttctttattcacatattgcattgttttacaaatggaacctgcgagtctatggatgccatctttttaacatggtctggaactgaacctacaatatttctgagaaaattgactttgcttctttgagaacagcatggtgagtctactatccttgacttttcatcaatttgtttcatcactaaagtatttcaagttgctgtctacgtcaaggcaagaaattctgtagggtttcagctgaaaaatcagaagccacacaggcttgctggaacacacagctgcatttccagctctgattttaaatgtgcwctatctggatccatattctggcacaatctgcctcttgtgatgaagatgaaaatggttaccttaaagttctcttcggtcaggccttcttcagttttagcatctctaatcattgcagcaacgtatcgcttcaccaggttcctcataacttcctgaggcattttagaacaagagtattgatactcaatgagtaaataaatttcctcctgagtcagttctgaaggggggactgcattttattttagtgaaaatttcaagacatagtacaaggacaacttacttggtattggtgatgtcttctcaagttatcagcagctcgcctctgaaaaggaaaaggacattcctttctggttatactgttatattactattctaaaaaataatttatttttttaatcgaaaaaaaaaaaaaaaaaactcga

SEQ ID NO: 87 - DNA, 863 bp, Homo sapiens
  misc_feature (7)..(7): n equals a,t,g, or c
  misc_feature (298)..(298): n equals a,t,g, or c
gggcagnagttccatttctgccgtggtcccagcagcgtcgctgtgggtctggcctgggttgcgtgtgtttcgtatgtgggccgtgctccctgcttggttcccttttcctggaacgtgtcactgcctccctgtctcgctccgtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggnaaagtccttttccttcttgtaactgagaagaacttgccttgagccacgtcaagtcccgtccgtcgcagccactgcccacaagcgtgagtctgctgtgagccagcggctccatggcagggcatcccagcgccattcctgccttcacacacacttgctgccgtttccctgtgctgggggctgtgcargtctgcctcggtgtggacttttctcttaggaaagagccccaggtcggccgagcacggtggctcatgcctgtaatcccagcactttgggaggctgaggcgggcagatcacgaggccaagagatcaagacaatcctggccaacatggtgaaatcccgtctctactttttaagtattttatacttaaaatttttgtattttatacaaaaattagcgggcttggtggcagatgcctgtagtcccagctactcgggaggctgaggcaggaaaatcacttgaacctgagaggcggagattgcagtgagccaagatggcgtccactgcattccagcctgggcgacagagcaagactctatctcaaaaaaaaaaaaaaaaaactcgta

SEQ ID NO: 88 - DNA, 1276 bp, Homo sapiens
gtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggccctgggaaaccagcccagtttctkgcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtcccacctggggactcttgcccccacatatttctccaggtctcctccccacccccccagcatcaataaagtgtcataaacagaaaaaaaaaaaaaaaaaaaaaaaaaaaaattgggggggggcccc

SEQ ID NO: 89 - DNA, 2084 bp, Homo sapiens
  misc_feature (2075)..(2075): n equals a,t,g, or c
  misc_feature (2083)..(2083): n equals a,t,g, or c
ggcacgaggagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtccccccaagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcttggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtyaggaagtggacactaacatctgtgcaggtgttgacttgaaaaataaagtgttgattggctagaaaaaaaaaaaaaaaaaaaaaaaaactcgagggggggcnccggtacnc

SEQ ID NO: 90 - DNA, 1765 bp, Homo sapiens
ggcacgagatttctgggagtcctgcagagtctagttgccaagtggaacattcttaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaaaaaaaaaaaaaaaaaa

SEQ ID NO: 91 - DNA, 2494 bp, Homo sapiens
ggcacgaggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcacgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaaatccggaaaaatggggtttaaaagaactgtctctttcagtctacatttttgtttaatacgcttgagcaataaacgcttacttgcaaaaaaaaaaaaaaaaaaaaaaaaaaa

SEQ ID NO: 92 - DNA, 1630 bp, Homo sapiens
  misc_feature (527)..(527): n equals a,t,g, or c
  misc_feature (546)..(546): n equals a,t,g, or c
gaattcggcacgagattatctgtcttcttcttaccaatttatagaactttttagtattgcagataaagttcctcatcggatatcttctctccttctattgggtacctttttattgtcttaatgggggtcttttaatgaccagaagttcttagttttaaaatagtccagtttatccatttttaaattgttagtgctatttgtgtcctgcttgagagatttttgcctactgcaaggtcacaaagatgttttcctctaaaagccttttggttttgcccttttgttttagatctgcagctcatctggaattgagtgtgtggtgtgtgtgtggtgtgaggtaggggtcctttttttcatatggatatccaattgacccagaacagtgtattgaaaaaaaaaatctgtcttagtcaatttggactgccgtaacaaaataccataacctgggtggcttagactacagaaatgtagcgctcacagytctggaggctggaaggccaggatcaagacaccagcagattcggtgtctngtgaggacccactttgtgnttcatagatgtcaccttcttgctgtgtcccagtggtgraaggggcaaactagctcccttaaacctctttttataagatccctaaaacctttaatgagggctccaccctaatgatctaatcacctctcaataccttatcttgggggttaagatttgaacagaggaatttgggggagacatagacatttggagcatagcatcttcttttcctcagtgcacagcagtgctgccttcatcatcagtcaggtgtctgtaggtgtgtggctatttctggacttggcactctgtcctacttgttgatttctctgccttataccaatgccacaccatcttaattattgtaaccatcttaattatttataaaaagtcttttttttttttttgatacagtctcactctgtcccccaggctggagtgcagaggtacagtattggctcactgcaacctctgtccccaggcttaagcaattctcatgcctcagcctcctgagtagctgggattacatgtgcaccaccacacttggccttctttcttttctttccaayccattkgttttttatttctttccctkgctttatkgcactggctaagatttccagtgctgaataggagtgatgacagtgggcacccttgtctttctcccaacctcagagggaaaagtatccaatgcatttgtagatattctttatcagattagcttcctttctagcggcttgtgtctttgcattgtttttcatgagcaagtgttgaactttttcactgagttttccaaatactttttccattgagtttttttactttaaccgtcatattgccaaaagtctgcatttgttatttcctcccaaattgctgggattataggcattagccactgcacccagccagactttatagaaaatcttgatatctggtcatggaagtcccctagcttggttatttttttttggtaccgctttgtctattttcggccctttccatttccatgtaacttttaggatcagcttgtcagttcctaccaaaaaaaaaaaaaaaaaaactcgaggggggcccggtacccaaatcgccgggtagtgatcgtaacaatc

SEQ ID NO: 93 - DNA, 1860 bp, Homo sapiens
  misc_feature (912)..(912): n equals a,t,g, or c
cctagctgtccccctgagatgaagaaagagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctgkagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctgccggtcacacagctccttccaggctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgctacaggacattacagtggctttcttggactgggcacttgccntgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctaraaaaaaaaaaaaaaaaaaaaaaaaaaaaaaaaaaaaaaaaaaaaaaaaaaaaaaaaaaaaaaaaaaaaaaaaa

SEQ ID NO: 94 - DNA, 1509 bp, Homo sapiens
ggcacgaggatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggctttatccttaaagagaatatgtccccagattattagcacttttagaggagaagccaaggtatgtaggggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaaaaaaaaaaaaaaaaaaa

SEQ ID NO: 95 - DNA, 967 bp, Homo sapiens
ggcacgagggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggcatcatattggtcttatgcctcctagacccctgtgccctgtggcactgggtggcaccctcctccatggtggggggcagagaagcctcacagatcctcccctaccaccaccagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccagtgatccactggccccacgtcacacagttacagtgaagcccaagccaggcctggttgagggtgataaacgccactgtctctaaaaaaaaaaaaaaaaaaaaaaaaaaa

SEQ ID NO: 96 - DNA, 885 bp, Homo sapiens
  misc_feature (233)..(233): n equals a,t,g, or c
aattcggcacgagagggctgcatccttgcgttctgtgagctctgcccgttgggagcatccatgctgatgtgcaggggccgtgcagcactgcattcttcttgccttctctgttctgtttagtacaaccaccccagcaggtctccagttcctgccaggttagtgtggatggcccagcaccatctcctctccatcttgttggctatcctctcttgttcctcacaaccccgccaggntcgcggctcaggagctctgccgtgtgaagtgtgctcagcagttctcctcacatgtctacgcaaaatctctggctccctgtgtgtctgagcccaacagacacactgagcacaggagttggctctcagctcctcccagcttgccgtgactgagccytgccgtcctgtggcamcgccasggagaccacagtgtccaactgtccaacctttacgtaattggcatcccaggaggagaagcaagagtgaatggggcaggaaaagatcattaaagaaatcgtggctgacataaaaaaggatgagttcatgtcctttgtagggacgcgtggatgaagctggaaaccatcattctgagcaaactatcgcaaggacagaaaaccaaacaccatgtgttctcactcataggtgggaattgaacaatgagatcacttggacacagggtggggaacatcacacaccggggcctgtcgtggggtgagggggatggggcagggatagcattaggagatatacctaatgtaaatgacgagttaatgggtgtcagcacaccaacatggcacatgtatacatatgtaacaaacctgcatgttgtgcacatgtaccccagaacttaaagtataataaattaaaattaaaaaaaaaaaaaaaaaactcgtag

SEQ ID NO: 97 - DNA, 853 bp, Homo sapiens
gggtcgacccacgcgtccgggtgaattaacacgtacccaatggccaagagtagatttgggtgtcagtgataaaattttcattttcaaaaacctggtgttctcagttacagctttatataagtatagtaataactttagcagagctgtagagagatagatttgcaaacttgaagtgatatgggataaatctccatacgtggtagaattttatataaaatggcatatttcaaggtatgtgtgattatttggtttcagcaattctgtgttgaagaaactagtatcataaaaaatgttcgtatgctgacatcagaattccagaattcatatgccacccctgtttctgggctccttcctggtgctgtggcttggaggggtggtgctgtgtacgggtgggtgaggcacgccatgcaggtattgcagaaggaacccacgcaaccgtcatcctttctacccccaagtgatgctgcctcattctggggtcctgaaagtaggcttcacttaacatggtagggaagtttctggctgaaaaagcaaaaggcttttatcactggagtctatcctgagccccctgtgcaaaaggcagtgtgaactcaggggacagaatcactgaagcttttgtaaaagcacaacatctgcctatcacagtccaaaggggacttcaaaatcaagaatgtctgtgacggagaagatggaaacagagcctggctgatggttgtaggtgaatcttctctgtgtcgagatgttatcagtgaccgttttctttatttcatgaagaaacatttttaatatattcacctccctgcatatattctgtttactgtgttattgttaaaaaaaaaaaaaaagggcggcc

SEQ ID NO: 98 - DNA, 400 bp, Homo sapiens
tcgacccacgcgtccgccctgcatggcgagatgtcctcctttcccgggccacagtgtgtgcaactaataaacctcctccatctcatctgcccagtgtcgggtcttgtgtgttcagccatcaccatagccctcaggcagaagtccatccctcaccaacagggaagagaggcagtgatcaaaacacctcctccaggaagtcttccctgaagttcgtagtctggcttcagtgccacttcttccctgccctcatattcgctaaccgccacttactgcctggttttcagcctcactaggatgtgggccactaagggccaacatggtcctacttgcagctgcattatcagggcctaccataacaccttccaaatgcttaaaaaaaaaaaaaaaaaaaagggcggcc

SEQ ID NO: 99 - DNA, 1261 bp, Homo sapiens
  misc_feature (481)..(481): n equals a,t,g, or c
gttttcaaactcatttctaagccaaatagtttagataaatatttacccttatatttggggggaattcaggctcaccatttgccgaggcaagcccatcaacagtctagaggcatattctgtgtcattccttcccgtctccttcatagaatactactttttccttttgtctcctggccattctccatcatctgctgattattgctaaccacaggatgctggcaaagcttacagtgataggcacatgtgttcagtgatgtccaatacactcttatcacagtggttattgcttcttactcttttcaaatgcattattctacccctcaacctayatccaatcattagaactatacctgactggagcccagaacttgggaccaatacttaattcaaatagcaggggcttgctcacaaacattaagcccaamaagaagcacagcactttkgaaaagtcaaataggsctttggtagctctgtacatttngcaatttacattgttattaagtttatagcactaataacacttcagtcgtgaatctacagtctcaatatgataagtcttagaacatgttctagaaatagtggtaccttgctgctattatacttagtaacttataccccaatataataataagtattaaatacagattgtgtatgcattctttgtgtgtatatgccaactgtactacttaacctcactgatgagcaattagaaaaatacacaaattgtcatagtgaaaataagtcttggtcaattcagatgatacgtgaacctgataaatgctctaatagatatgctattttgtcctgtattgcttgttttacagtatggtgcatgttgtttgctaagtaaaatgataataataataaagtatacccaattttaaggttagaattaaaattttgcacatatgcttcttgatattctgaaatgtattctgtggsttmattatcttattcatacacattkmgctwggctttttacccctaggaaataactgtccaagtatatatctcgtcttctttcttgtaactttgattaaactgcttacttcaacttacaacattgtaaagccagaatacctcattttaacagtgaaaaaaaatattatgacctgatgtgttctcttgtatttgatttgaactacctaaataggcttaactgtaataataaatatacaattttggcaaaaaaaaaaaaaaaaaaaaaaaaaaaaaaaaaaaaaaaaaaaaaaaaaaaaaaaaaaaaaaaaaaagggcggcc

SEQ ID NO: 100 - DNA, 639 bp, Homo sapiens
gaaaaaatgctagggagacaaaatcaaatgttaaggggctgggctctcagcacattcttggtttgcattctccagtgggtcagaagcctgacaatccgcctagcctctgctttgagcgtcaggggacccagttctattcctgcatccttagccatcatctacacactttttatcttttcttttaaatttttaaaaattgtgaaatctatatacatataagccatatgttcaacttaaagaatagtaaacaactgtgtccctaggatccaagttaagaaatagatcagagtcagtttcttagaagcttctatatgtgcttctccccagtcatgtgctctcctgtctctacctgagggaaattacagatttcatgcttttctttatagttttcctttacacacatacccttaagcctctaagtactatatggttcggttttgcaaagcccagaagcctattttaatgctgtatataagaatatgctagccgggtatggtgactcatacctgtaatcccagcactttcagaggctgtggcaggagggttgctgaagcctaggaattcaagaccagcctgggcaatatagggagaccccttcactacaaaataaaaaattaaaaaaaaaaaaaaagggcggcc

SEQ ID NO: 101 - DNA, 790 bp, Homo sapiens
  misc_feature (37)..(37): n equals a,t,g, or c
  misc_feature (55)..(55): n equals a,t,g, or c
  misc_feature (76)..(76): n equals a,t,g, or c
  misc_feature (112)..(112): n equals a,t,g, or c
  misc_feature (120)..(120): n equals a,t,g, or c
  misc_feature (137)..(137): n equals a,t,g, or c
tcaactgggtgaaaaggaaaacccacccttggcgccnaatacgcaaaccgccttntccccggcgcgttggccgatncattaatgcagctggcacgacagttttcccgactgnaaagcggncagtgagcgcaacgcanttaaatgtgagttagctcactcattagcaccccaggctttacactttatgcttccggctcgtatgttgtgtggaattgtgagcggataacaatttcacacaggaaacagctatgaccatgattacgccaagctctaatacgactcactatagggaaagctggtacgcctgcaggtaccggtccggaattcccgggtcgacccacgcgtccggttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctawwaaaaaaaaaaaaaaaaaaaaaaaaaaaaaaaaaaaaaa

SEQ ID NO: 102 - DNA, 3576 bp, Homo sapiens
ttcatctgcctctcgcaagaaaaagtcctggtaaatacacattagcatttccgttttacacagaacactgacagatactttcctaagatcatggagttaatacccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagcttgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggatatttctggaagtcactccgtgaggctggtaatcctcagacccagcttctggtcgactctggaatggactgaagctgggcaggatgatgagagccagggaaaaaagaagaatcaaaacacaagtgctggtctgggcagctttgttggaagtttgagcaattagcgtctgcagctggcggagctgagctaccaaggagatgttgtgcctctccagctcctggacttttttctgtaattcttggttctgtgcagaacaggctgccaccctgctctccagcccatcaatgtactccttcttccgccgccgactgtcctgagctgactgcttgttacggattttcctcctgaccttcttgaggaccctctcctctgccttggtgaggggcaggtgagagggcagggaaaccccttcctgccccagcagacgcttctcctcatcggtcaggaacagggtttgacagggcagcagggttgtacagggcactggggctacggtgcctgctctgggcaggatgtgggcatgagcatcaaagggcagctcactgaccatgcaggaatcaggcaccataaatgctgggctccactgatctagctggatggagataaggcctacatttggcccagtttccccctgcatcctctccagggcccctgcctcatagacaacctcatagagcataggagaactggttgcctgggggcagggggactgtctggatggcaggagtcctcagagatgccactgtcactgccaggagatgcttctgagcagtacacctcattgggatcaatgaaaagcttcaagaaatcttcaggctcactctcttgaaggccacagccacggtccccaccggacttccagccttgcagtccctgttcctgtagcctagttaccggaacctctggaggggggcagtggagtcccagctccaggacggatcctgtcgagaagatatcctctgggggctccagccacgcgtccagcaggtcagggattccgagatccatgcttactacaaaagtggatgccaccttgccaggagccacggtagggccgctgtatctgggagtaggggactaagagtctgagggtccacaaacggaatttaagaagtaggtagccgcgccctttctgctgcagttttctcttagctatagtaaatcttcctgagggtttggtgtctcctagctgaagaacagaaaaggctgtgac

SEQ ID NO: 103 - DNA, 1262 bp, Homo sapiens
cagcatgtacccagttgttctttctcctgagaaagcaaaatgcctgatatttcttataatccaggctgccacgtttaccttgtaaaatcaatacttaatttttagatttttatattatcttttctcgtgaagcaagacttctaaattatggctataatatcttttgaattgttgttcttaatgaatcttccaactgtaaactcatctaatttcaaacttatcatacctgaggatgtaacattgtcctttgtttctcatcttgatattaccgtcaatcattttgtatttctgagtacatttgaacttgctggagtaatagagggaaaacctctgcctgattctaaatcagatctttgtcctatactcggacaattatggtttcatattttattattttttattttctgggtttaacaaatgagataacattttagacataatatttgtaaacatcttgacttatttcagcattttccttttttgtgtatcttcagagagtttgttgaaagtagcaatttccaagtaattttaaattattgaagtctactagcacgaaaggtcaaattcttaggatatttaaaaaatgttgtttaataatcaaactcatcttaaaaaatgttcatcagactctgtctttgatgcacattttgccaaaagagagccttatttctgtgaaagaaatacagtatgtactttgggatttactaaagtaaaactgttactttaaggcacagagcagatatagaatccccctctctccccactcctagtgactggtattctacattaatatttatcttccatgcatagtgtacttgagggaaaaaaacaataactcttaattgtttaatatcaaacaataaaatcctgtgtatcagtgactgtcaatagatggctttctgtttaaaaactgaagctactccagaagtaggaattaatttatttagtaaacaaagtcagtcaaaccagagccatgtcctggggaactgtcaaaagaatggttcctaagggccagaggccacatccactggtagatgacagaacaaccatacttcagatggcaaaaccggtcagtttggtttgcgttgtgtgcctatcctctttctgtgtgcttcagctgaattaagtgcttggagagctcaaatagttcaagatagccaagatgaccaattctgccaggtggcaagcctgatcttgcaattttgattaaaataaagaacattccccaagaacagtttgttgcaaaaaaaaaaaaaaaaaaa

SEQ ID NO: 104 - DNA, 614 bp, Homo sapiens
ggcacgagccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaaggctggggccctaatgtttgtcccctctgggctggggtggggggagggaggaggttccgtcaggcagctggcagtagccctcctctctggctgccccattggccacatctctggcctgctagattaaagctgtaaagacataaaaaaaaaaaaaaaaaaaaaaaaaaaaaaaaaaaaaaaaaaaaaaaaaaaaaaaa

SEQ ID NO: 105 - DNA, 958 bp, Homo sapiens
gaattcggcacgagtgagattgcatccagacagagttttaaaagtttcccggttgagtttaatgtacagttgaagttgagacatgaatctctgcatgtaggggaaattttgtgtctggttagtcaagaaactatggaaaccaattcttgatattttgaaccattcacgaagatagtttgagtcatgagcatgctgttgtctagagtgggcggggatgactcattggagtggatgcgctgctctgtacttgatttttttgagtctgaaattagctttccaggctggggcagggaggggagcacaggtgggatcagtactgcccccaagcggtggagctgtggtggtggatcaaatactgctgccgcctgtctgcacaaacatatttctctcttccagcccttcagaagtgtattggaatatgtcgwtaacaataatgatggtagtgaagatgatgatgatgtgggtaattctggctaccttattgggtccaagctccccacaattcgttgcacaaagcactctacatacattctctttagtcctgatcaaaccacctttcagagtaggatttagtgtcctattttaaagatgaaggagctcgggctcagagagagatcgtttagacacacacacaactttggaatgaaacatttacagccgggcgcggtggcgcgtgcctgtagtcccagctacttgggaggctgaggctggaggatcgcttgagtccaggagttctgggctgtagtgcgctatgccgatcgggtgtccgcactaagtttggcatcaatatggtgacctcccgggagtggaggaccaccaggttgcctaaggaggggtgaaccggtccaggtyggaatgaaacatttacaaaaattgacatttccttatgcatagatatttcactaggtccttaaaacccacgtgaatctgtgattaaaaaaaaaaaaaaaaaactcga

SEQ ID NO: 106 - DNA, 1343 bp, Homo sapiens
ggcacgaggtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcaatccatgagggactcctcctgtggaaaaggagagctgttccagaacacagaactgatctcaggtttttgaaaaaaaaaaaaaaaaaa

SEQ ID NO: 107 - DNA, 712 bp, Homo sapiens
  misc_feature (20)..(20): n equals a,t,g, or c
  misc_feature (44)..(44): n equals a,t,g, or c
  misc_feature (56)..(56): n equals a,t,g, or c
  misc_feature (128)..(128): n equals a,t,g, or c
  misc_feature (625)..(625): n equals a,t,g, or c
  misc_feature (692)..(692): n equals a,t,g, or c
  misc_feature (699)..(699): n equals a,t,g, or c
tgttgtttggaattgtggancggattaacaatttcaccacgggnaaccggctttgncccatggattccgccaaggcccgaatttaccccttcactaaaggggaaccaaaagctggagctccaccgcgntggcggccgctctagaactagtggatcccccgggctgcaggattcggcacgaggtttcctgtcagtgctattgagattttattttattaatgtctgcacttagttttacttcctactttctacttttattgagagttaaacctgttgaagtctcaggttcaattcctcaccctgagcaacctaatgttttatgtcttgttcttcctacatttggttattgaaactgaagttttaggttaccagatttgatagaagcacataagactacttactgctttagtctcaattattaattgagaaattatcaattaacaataaggatttctcttatttttccccaagataagttatatatttaaagtgtgttttatagtagaaaggttttagaatatttgggttgctacattaattgaaatggcagctgaagatgtgatttccagccagggatttattaaaaaaaaaaaaaaaaaactcgagggggggccgtacccaatcgncctatagtgagtcgtatacaatcacgggcgtcgttacacgtcggactggaaacctgcgtaccactancgctgcncacaccccttcgc

SEQ ID NO: 108 - DNA, 1106 bp, Homo sapiens
  misc_feature (1017)..(1017): n equals a,t,g, or c
gagcaagctcatttttttttcctatgaggcttttgtaagtcctgacctgtatttactgttaacttcttagcttgggttcatgcacccccagtcagtataactgtggacctcatacccactttggcacaggcttggagtatggatttattacaggtctgtttctttttgtttttctcccatttatggtcctggacagaaggtaagcttccttgcaacttccctggtccggtgggtagagttttcttgtcccctttccagatgttaggttttaaacaatgactgttctttctccatcatgtagaccaaaggccaagttctgtgtccccatgggagattaaaacccaagcccctatgtctaggtccagtgcccactgatttctctaattgtgagtctttctgcttacctagtacctagagtttctcttcccaagttttaaaaatatcagttctaagtaggcctagcgtttctacatatttttagggagaggggaccctttctgtggcagctcagtgttcagcattcctgtaagttagcatgctctgtgtatagcagatatcactagtaatagcatttrgtaagtgatgttcacacatgctgctgtcatgaacactatctcatgttgtgtaacactttcatttttccaagaactttataatcagccgacttgaaactcacagtcgtcccctcagaaaggcagggcaaatgttgttatttccaatttgtcagaagctcagaaagcttattctgttgctgacagtccttgcaagggtcagaatcaggaccggagccccagatgcgctggtgtcactgatgtcccgtgccgggcatgagcccttctgtgcaaggagctccagtgtctcccggacagtgatgatgtgaaaacatttagaaccgacctacacaataaggcagattttcattctgtacccaaaacaggaacacagatttaatgcagagcaaaagggctttaatcaacagatatgttcatttttcacgtagacctattttacaagctnacttgtaagccagaaaatgacattcgagattttcaagtgagaacaaatgatttggtccaataattaaaaaaaaaaaaaaaaaactcgag

SEQ ID NO: 109 - DNA, 1254 bp, Homo sapiens
  misc_feature (1036)..(1036): n equals a,t,g, or c
  misc_feature (1069)..(1069): n equals a,t,g, or c
  misc_feature (1100)..(1100): n equals a,t,g, or c
  misc_feature (1165)..(1165): n equals a,t,g, or c
gcgtccggagagctacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttttaaccccagaatgtgacctcctcctccagttacccanagccctgccgtttgcagggttgggggtggtcancggtaccccggggttaggcatcctagacagnagcctgaggaagctgggagatttgggccatgtagctgcctttgttactctatttattttagtcanttgtataaaacaccaaataaagcaatagaggcaaaaaaaaaaaaaaaaaaaaaaaaaaaaaaaaaaaaaaaaaaaaaaaaaaaaaaaaa

SEQ ID NO: 110 - DNA, 679 bp, Homo sapiens
ggcacgagtttttatcttagacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggcaaaaaaaaaaaaaaaaaaaaaaa

SEQ ID NO: 111 - DNA, 865 bp, Homo sapiens
  misc_feature (365)..(365): n equals a,t,g, or c
gaattcggcacgagtgccctcgtatctacatgctcacctataccctcacccgacttttccctcctcctcaccccatcaaaggcaataatgcacctgtttttattcatctgggcctttggtcttccccttcatatttcccgagacctcgctttcttctttctcttgtattttttatttttctatctcttatgtgtccttctctaaaagttataaacatgcacaaaatctttccatctcaaaatataataccctttacctggtgtcccctgcaggccatcttctttatttatttacttttgcgccaggtcttcctctgaagcccaggctgggtgcgtacgcgatcatggctcactgcagcctcggantcccgggctcaagcgatcctcctgcttggaggatcagattttttatccttgcagaagtgataatatggcttcttcctcatctcctaaacaccagtcatctgacatacactgcagatctaaaatgggccttacgtgttctgcccttccttgcctacctgttgagcttgcaccgcttctgtgagtctccccccacccacaagagatccttcttccttcgcgctccactaacccgacataaatgtttatcatataaagttttccgttgcactcttgtgtttatgtctcctggcttcttcaccaagctgtgtgacagctgggccctgtcgcctccttcctcgtatatgcagcgactatcgcagagccgcttaatctttgttgaaggcagctgcggttcagccctgagggccacgggacggacgccactcattcagycctaccgggggcgctgtggcagccggcattggttgccgtgccctccgcttgtctcgctcagccctcga

SEQ ID NO: 112 - DNA, 1139 bp, Homo sapiens
acgcgtgggtccggacgcgtgggcggacgcgtgggagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctscacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtcwmaaaaaaacggcacgagcggcacgagctacgtggg

SEQ ID NO: 113 - DNA, 1222 bp, Homo sapiens
  misc_feature (772)..(772): n equals a,t,g, or c
  misc_feature (796)..(796): n equals a,t,g, or c
  misc_feature (823)..(823): n equals a,t,g, or c
  misc_feature (855)..(855): n equals a,t,g, or c
gaattcggcacgagcacatgwktatatatatattactgttttgcctccattgaacatgccttctacttcctaatttgtgccagaattgactagtagacgctatgaatgcatcatgctctttggcccatttcgaacactcaggtatgtctgtactcttagttcatctattcatcattgtttctacagttccctcatgctttaaaaaatatatggcttttataatttatccagctttttcttgtcattttaataagagtatgtgtcttatacaactactacattcatcccagaagtagaagcaaactattataatcccattatttttattcctactattctcttttcagaatttcttttagatattccttggatagttttattcaatcctccatggctttcagcttatcttatgttctatcttttggttcatattctgcattctggataattcttcatcttcactttctagtttgttgatattccttttggtgactataagctgctctttaaaatggtcaataatgcctaagatgtttattatcttgccctttgcagaaaaaaattttcagcttttgctctggaatgattttgcatctcttccaccaaacttccagtgtatcaatggccagaaaataatctatatgttaatttgttaatttgatggttcatggttcaaggctgtataatttaaaagtttgaagtcaaacaacacatgatgggataatcctgatgttacagattctcaagggaaaatatgtttttgttttttctnccaattgttctartatttacaganaaacttcttaattatactgggttggtnaataartatttttcttwactctttcaatctangtccarctatgcatcaccccttcgctgatgagcattaagaaaatccaaatttggcccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagctgggcgtgatggcgggcgcctgtagtcccagctactcgggaggctgcggcaggagaatggcgtgaacccgggaggcggagcttgcagtgagccaagattgcgccactgcactcccgcctgggccacagagcgagactccgtctcaaaaaaaaaaaaaaaaaaaaaaaaactcga

SEQ ID NO: 114 - DNA, 627 bp, Homo sapiens
ggcacgaggaattttctttgaagtattttaaaagtaagcgctttactgtgtgagccctggctcttggccagtcctatgaatgggccttagatgatgcccctgaaattgcatgcaaaatgtctttatttgctcaaatgtgtattttttgtgggggtggggggaatgaccttttatcagattctcacagggttcaagatccaaaaaagtttagatctagtgggttaggtgtggatttctctgaaataggccagggaaaaggctgtgacctctccttgggtctgctgcagcgttctagccttggctaggtgaggggaactgttgggccgatgctgtgtggctggagcagaacccacagtgctgtccatagaggagaacaagcaacgaagatcatggctaaagatcttagagatccttaaaatgccgattcctaatctcttgctgaaaactactgacttttagatattttcccgcttgccactctgtaatccagaatattaggaacaagttcttaaactcgagtttacttttcactggtgtttgcatgtgtgggggacaaaagtttatgttcttgtggcaggaaactgtgggatctgcagcatggaggagtttaaaaaaaaaaaaaaaaaa

SEQ ID NO: 115 - DNA, 367 bp, Homo sapiens
cggcacgagtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaaaaaaaaaaaaaaaaaa

SEQ ID NO: 116 - DNA, 875 bp, Homo sapiens
  misc_feature (66)..(66): n equals a,t,g, or c
  misc_feature (872)..(872): n equals a,t,g, or c
ggcacagcgcgaggctgggtcccggcccaggagaaggaagtcgctgaaggcagtggccatgctggncgtggaaatgggaggcggttgcagrgggtctatggggcccggtcctggatactcggcaggaagccgtgtctgcagaggctcctccctgcctcaggtggccccgttcaaccccagccgtgcccatctcctgccaccgcctgtcggtgggggtttaaattcggtgtggctttctggggtgcagctcagcacccccccttatgcagactgggagggggtcgggcagtcccctcagccacgaggaccctggatgggttctagttcacttgggaccgtggggcctggctgcgtactgagtgggtgccccacagtcaaggccaacgggggctccccctgctctgagatgttgggagaaaggcggcttctggaaccttccgtgggacccgtaagtggctgtccagaaaggcgggagggtgggcacggggcacggggggcagctggggtcgtcgttaagggtcacgcatccgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaacttaaaaaaatttttaaaaaacataaaactactctctacctctgctggsccagcctgtctcgccctggccgcggcagggtggcctgtaacaatttcagttttcgcagaacattcaggtattaaaaggaaaaaaaaaaaaaanggg

SEQ ID NO: 117 - DNA, 320 bp, Homo sapiens
agggcgcacggccaattgatgggcatgatccttgtgctggcgagcttcctggcgcacccggtcgaggcgctcgcgcaagctgtcgcgctgggccagcagcaactcgcgctgctcggtgtscarrgccatgctgtcgagggcttcctgcaattgcagrcgtgcttcgccgrcttgttcgtgttcgarggcgcgttgctcgcccatctcggccacttcttcgtcgagccgggtgcggcgcagggtcagttgctcgaccttggccttgytcgccgagagctgggctttcaattcgccctgctggcgcgcttcgtcctgcaaca

SEQ ID NO: 118 - DNA, 1283 bp, Homo sapiens
  misc_feature (1)..(1): n equals a,t,g, or c
ngggcgttccatcgaggcctttgatcgcagcatcgacctgctggtgtcgcgcctgcgccagaagctgggggatgaccccaaggctccgcaattgatcaagacggtacgcggcgaaggctacctgttcgacgcccgggatatcggttgatgcgcgcgcccttcaacacgctgttcgggcgactgttcggcctgttgctggtggcgattgtgctggcccatgtgctggcgttcttctggttccaccactacggcccgccgccaccaccccgcgcggccttcgtcgaacaaccagatggcagcctcacgcccttgcgcaaagcgcctcgcccctggttcggcggcccggtggtgcccctgacatttcaatttatctcgctgatcatcgctgcctggtacggcgccaaactgctgagccggccaatccagcgcctgagcgcagcggccgagcgcctgagcgtcgacctcgacagcccgcccctggtggaaaccggccctcgcgaagcacgccaagcggcctcgaccttcaacctgatgcaaaagcgcatccgcgaacaagtcagccagcgcgcacgcatgctcggcgcggtctcccacgacctgcgcaccccgctctcgcgcctcaagttgcgcctggaacaaatcgaagaccccaagctgcaaggccagatgcgccaggacctggacgacatgatcggcatgctcgatgccaccttgagctacctgcacgaacagcgcaccagcgagacacggcattggctcgatgtacaggcgttggtggaatccctgagtgaaaacgcccaggaccaaggccgcgacgtgcagtttgccggcacctgtacaccgttgcaggtacagccgatggccctgcgttcatgcctgaacaatttgatcgataacgccctgcgctatgccggcaccgcccgggtggaactggccgacagccgcggtgcgttggtaatccgggtgatcgaccacggcccgggaatcgccgccgataagcgcgaagcggtgttcgagccgttctttcgcctggaagggtcgcgcaaccgcaattccggaggggtcggtttggggatgaccattgccagggaggccgtcgagcgactcggcggccacctgagcctggaagatacaccgggcggtgggttgacggcggtgatgtggttgccgagggtttaagcactcccatttacctgacgcgccgcgatccaaatgtgggagctggcttgcctgcgattgcgcagtgtcagtcgatgaagtgttggctggcccaccgctatcgc

SEQ ID NO: 119 - DNA, 2777 bp, Homo sapiens
ggcacgaggggacatgtctgggcacaaggaaaggcaagcaatggaggcagcaagagcccttggcagcaagtttccatcacctttgcctgccagtgtgtgagaggcgcagaggggcagtgagcaggtgacatgcagcttccagatacccacacactgcttttctcccgcccagctcccaccccagttaattgagatgggattgtttctctttctggtttcttcctaagcccctctctcatattcctggtgtgcttatggcctggcacaccttgtgaaacagaaacccaagctcctcatttcggagctgggatttcgattggctatctgcctccctaaccaagctgtcccttccacctcatccctagagtcaccctctggtctcatcaacatccagtgggcatttcagtggcccaggatccttcaaattgcagatataaagcatcaggaccccacacctgggatggaagcttctaggaattaatgaagccccagtagaggtgagggtaaacctaaaacgggctggatagggcctctcccaaggccctatggaaaggtgatgggaaactgggggctgaggcctcatcctaggagacccctggagggacccacttaccctagataggcagcggaggccagaaactggaaaacagccactcattgtcggtgcattaccgtgagcaccacctgtagggactctgttggcctccagccgtcgtcacacgttcctgacaaccacaaaagttcatttgagggtgcccagtcagctgactttgcttccaccaggaatacccacctggccctggtccttctgctgagctacaggaggcattcccagggtcttagcaaaaacaacccctcaaataggcccagtgcctacaactctagagaggtttcagatggtattggagacccagagaagttaactgactttcccaaaagtcacccactgtaaatggcagacagatctcaaacccacatctgagcctgagtccagtgttttttctctagtatcatcattgtcccttaaatgtgtttgacacatcatagtttacaaatcaccttcactcatattctctcactactcatcagtcatgaattcagccaatgagaagggctcagagaggttaactaaccagccacgctgtttacatggggcatagactgcttcatgaacgcttgactgcagctttgccttcctcatgccctcaaaaaggaaggagctgaccaaagcttactataccatagctggggtctgggacccccagccaggtctcacagatgatctgggaatggcctccctgttgctctcaggggtccggcagtcacacagaagagtcaggttgaaatcttggcaagactttggtgtggctttgggaactgggtttaacctcttggggacttcaccaagacagtggcaaaggacaccacctacagcttccagtgcctctctactctcccacctgtgctcctggggttgaatgagaccagaagcagctgggacaagatttggaaagataaagagagccaggagacaagaccttgagagaagcagaggtctggctggctgctgccctctggtggtgacaatggtgacactgtaaacccctctgtcaaggtgacactctcccctgactattcaggagggagaagcaatcgccccaggacagagacggggacatcccaggagcagggtacaggctctagcaatatccatcttgcggtactccctccctcacaacaaccagaccacacatgtgttaaatccttctgcagggatggaatgcggctctcagttttttccaagaacttctaatctaggaattaggagaggtggtcaaagctgaatgaagcagtgggcaaagagagggtgagggatgggagagaagacaggtcaaggaggaggtgggagagaaggggagggttgcatgagggacaaggaaatggcatgggttggagctgtccccagtccctatctggagggacttccaaccttccagattcccagctgatatcacatgtccaacctcagccaggcgatttataagagaaaggtcagggatgccactccccttgtaaaagcaaacatgcagcatctggagaagcaaggggtagatacaaagattccaaggggtcaccaacagctacccagagaccagctttcatcctatagagaagggtctcattactttgcccttccttccttccttcctctctccttccttccttccttccttccttccttccttccttcctccttccttccttccttccttccttttttctattctattgatcattaattatggtcaaaacttctcattttttcagccaggcagggtggcttaagcctgtaatcccaacactttgggaggcgaggcaggcagatcacttaagtctaggagtttgagaccagactgggtgacatggcaaaaccctgtctctttaaaaacaaaaattaaggccgggcgtggtggctcatgcctgtaatcccagcactttgggaggccgaggcaggcgaatcacgaggtcagaagatcgagaccatcctggctaacatggtgaaaccctgtctctactaaaaatacaaaaaattagctgggtgtggtggcgggcgcctgtagtcccagctactcgggaggctgaggcaggagaatggcgtgaacccgggaggcggaacttgcagtgagccgagattgcgccattgcattccagcctgggcgacagcgagactccgtctcaaaaaaaaaaaaaaaaaaaaaaaaaaaaaaaaaaaaaaa

SEQ ID NO: 120 - DNA, 710 bp, Homo sapiens
ggcacgagctgggcctccaggttcttcacctgtcacatgatcattttacatattgtggtctgtttatttaccatcagcatcatagaagagcaaaaagaagaaatactgtgctccactaaaagccaggctgagaaaacagttactcacattgagcagtgagtgaccactaggtgggcatttgttcatagctgcatggagaacaagtgcccatatacatctttctgctgatgcagcctctaaattttgaatgcatcagttttttaaactgcattgagcaatattccgtgggtgtgatccataatagcgtaactatttacgcctgtgacagagaggaaaactgtatggatatcagatatctttaagagctttttaatctttaatcaagttagtacttcttaaggatgattaaggccaggcagtggctcacacctgtaatcccagcattttgggaggccaagatgggtggatcccttaaggtcaagagttcaaggccatcctggccaacatggtgaaaccccatctctactaaaaatacaaaaattagctggggtgtggtggcaggcgcctgtaaccccagctactcaagaggctgagacaagagaatcgcttgaagccaggagttggagattgcagtgagccaagatcatgccacttcactccagcctggacagcagagtgggacttcttcttaaaaaaaaaaaaaaaaaaaa

SEQ ID NO: 121 - DNA, 1540 bp, Homo sapiens
  misc_feature (651)..(651): n equals a,t,g, or c
  misc_feature (1124)..(1124): n equals a,t,g, or c
agaattcggcacgagggcatattactttcctaggactgccacaacaaactattaccaactagcggcttaaaacaacaagagcttattcctcacagttctggaggccagaagtccaaaaccaaggtgtcaggaaggtcatgctctctccaaagtctccaaggatgctccttccttgcctcctccagcctctggtcgtggccaacatcccgagggttccttggcttgcagatgaatcacttaatcccacccccatcatcacatggcagtccccctgtgtagctcagctctgtccaaatttcccctttcctacaaggacattagtcactggattatgacacagctcatcttaactggattatatctgcaaagaccctgttatatctgcaaagacgagttaacattcacatgttccaggggagatatgaattttaaggggacagtattggacccagtataggagggcaggcagcagcgagggagccagggagggctggcctgacttgagcctgtttgaaaagcatcatcctcctaccaagactgggggctgctggttctgacaaggtttgcaggatcagctgggatgatgggttscamccaytccttcgagytacgttggacccctgggcccacttacagcaaggagcttgcccntycgtgtagctctycgtcagtgtgggaaaatctgartgagccagagaagggtgagattccccctgcagagcaggcagtactgagcaaatccaggatccagaactccagttctaatcctggctcttgcctgctttcctgtgtgaccctggggaagtggttttccctctctgagactctccttccccatgtgagtcacaagggctgggcctagctgacccccaaggcccttacatgagtggatagttgcattttaaacctggtgctccccaggataagggagtcaaccccaaggagactggggtttctcctgagcctggcccctggggatgagcactcactgtggaaaaagctggccacttcttagcccttgtcatgggcagaaaacatgcccctccagccccaccagcaccaacacacagccaagctcactgtttcatttttagagagaaatcagggctttcggtgcagctgantgacacagacaaggggcggggggacatgaaagggagcgggcaaggacggaaattacacttctcctagcaacctggttctgcagctcctaggcctggggccgcgtgatacatgccattcccaattaacgggatgttaaatataccccggctcagcctgccccatgctgagccccgcctggggcagtgcagggagccatgtgatggtgtagagcactctgcaacaccccatattcatgttcccactcctagggccccgctcggtccccaggaggccagagcggtcctgccctctgcctgagcatggctcagctccagcctccacttgccctcccctatgctggccagctcgggggtctgcaggcagcctgtggggcagggccagttggccaaactctccaagccagaagcccctcgag

SEQ ID NO: 122 - DNA, 1428 bp, Homo sapiens
agcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataaggtactgatggttggcgtgaaatgagttttctaaggtgtggagattttgacttgatcttttagtcttagaaaaactaagatcctaaacctgtagtttcagaatgcaaaagaagaagctagtgtgctaccttatgttgagacagtatttctttttggtggtggtatctttgccatggccctgtgtcttatttcagatgcattatcctcgtaccgtgactcccacactaacagagtactgacctctccaccgtttcgcctcatgcctttccctccttcctctcctagactgctggttaccttggctgggagagaggatgtagtgggacattcctgtaacactttatccgcacatctactggaaatcgttaccatgttaataacttggttttgaattcatgttaacatgtgtacccatgaacatttttcattttcttttcatagtgcgatacataggtgcatgacagcattaacctggggacgtagaatatgatcaaggcagcattactgctttaactttagaatgacttactatttattaatttaaacagactgctgtttccacaaccttagcattgaaggtctttcattttctcccatcaagctatgttagtttaggtaatgtagaaatatttaccctctggcttaagctggtttagagtaactaactagagctatagtttgcatgggaaagtctgcacgagcttcttgtcagatatttcttgctcttctgtcgcattacttactaaacctcccaactctcatcatattcttcatttaaccacctcctacatgttttcttttggaccatggcctaaaatttaattgtttgtgttttacttgcgttggatttcaaatattatttgatgcttatttttgttttgtgtcttcttgtttctgatttttactctgtcacggctccatctcttacatgtagcttatgtcccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtggggtaagttctgctccggaatcctgtctctctggcgtgctttggttgcatgtttggttctgcataactaattttgtttgtgaatgaatccattgtgttttcccataacatataaaaaagttaaaaaaaaaaaaaaaaaactcgag

SEQ ID NO: 123 - DNA, 1691 bp, Homo sapiens
cccacgcgtccgcgcacctccagctcgggccgatgtggaagctttggagagctgaagagggcgcggcggcgctcggcggcgcgctcttcctgctgctcttcgcgctaggggtccgccagctgctgaagcagaggcggccgatgggcttccccccggggccgccggggctgccatttatcggcaacatctattccctggcagcctcatccgagcttccccatgtctacatgagaaagcagagccaggtgtacggagaggtacagccccgacgggccccgggcagggagggccgccaggctggcccgggctggccagggccttcctggttggacttatggccgcccctgggccgactagtcgggacctctccgtgtgccggctgccctttgagggacacccgcttcccgggtctggaagggagaagtcctcgacgccgtgcccccttgcagggggagccccgcccctgccggtgacccactccgggccgaggctccgaggcgatccagtcctgattttcccgctaccgctcgagctcttgctcctgcgcctgcgccgtttggctcgccagccgcgccgccacttcaggtccagggtggacgcatgccctcaggtgcgggcgtcttgcgagtcggcctcgcagctctgtggaagctgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtgtgggtgtcccgacgtccggagggggcaggagtttccacgggtcctgggacagagctcacctgttttgttttgaattacacttatttatatgcaactacaggcctgacgctagcggtgaagaaggcagatacagccttttaaggagttggcagatgagtgggagagagaaaactaatctcattatcggccacaggctgtggtcagtgttttgaaggaaaagtacagggatgtttggcaactgtggtatttcaggtttgaccttaaatccttacttaaaccagtttttacaaggattggtctaggtgcccgggcgcggtggctcacgcctataatcccagcactttgggaggccgaggcgggcggatcacgaaatcaggagatcgagaccgtcgtggctaacacggtgaaaccccatctctactaaaagaatacaaaaaattggccgggcgtggtggcgggcacctgtggtcccagctattcgggaggctggggcaggagagtggcgtgaacccgggaggcggagctttcagtgagccgagatcgcgccactgcactccagcctgggcaacagagccagactccgtctcaaaaaaaaaaaaaaaaaa

SEQ ID NO: 124 - DNA, 1421 bp, Homo sapiens
ggcagagggagcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgmggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcatccagctggccaaggctgtactgcggatgctcctgctgctctggttcaaggctggcctccagacttcaccccctatcgttccactggacagagagaccaggcacagcccccggatggtgaccacagccywggyaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggcttgcaggagaccatcgcagagtttttgtacattgcccggccgctgctgcacttgctcagcctgggcctktggggtcarargtcgtggaaaccctggctcttggctggtgttgtggacgtgaccagcctgagcctcctgagtgacagaaagggcctgacccggarggagcggcgggagctgcggcgccggamcatcctgctgctctactacctgctgcgctctcctttctacgaccgcttctccgaggccaggatcctcttcctgctccagttgctggccgaccacgtccctggcgttggcctggtcacaaggccgctcatggattacttgcccacctggcagaaaatctacttctacagttggggctgacagactcccggaaggagggtgtggggaggggtgggcagggagcccctcttccctaataaaactgactccggcagcaaaaaaaaaaaaaaaaaaaaaaaaaaaaaaaaaaaaaaaaaaaaaaaaaaagggcggcc

SEQ ID NO: 125 - DNA, 1489 bp, Homo sapiens
  misc_feature (7)..(7): n equals a,t,g, or c
  misc_feature (345)..(345): n equals a,t,g, or c
  misc_feature (549)..(549): n equals a,t,g, or c
  misc_feature (1408)..(1408): n equals a,t,g, or c
  misc_feature (1477)..(1477): n equals a,t,g, or c
  misc_feature (1488)..(1488): n equals a,t,g, or c
ggagganaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaarggatgggggacatngctgtgtcaaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaanaagctgggctgtgggtgcctcctcctgtatggtgtgttcctgtgcttctccatcatgactgagttcaacgtgttcacctttgtgaacctgcccatgtgcggggaccactgaaccgccgggtgcccacagargctcagctccttcttttctgtgcaatacgaracccggccgcacccgartcacacaggcccctggggccacggcgttcgtctctcctgtgctgtcctcaggcctccgctcctgttttggtggcccargctctcccctgccccatcctcgctcccccacctccttgggtcatgcccacccaccctttcctgcctcctccgtgtkaagacatccaacatccacgtgacttttccagctccatttttgaacagtgactgagattctagaaaaacccggctgctaactggcctgagccaggcaacactgattccaatccctyytccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcactaaagtcttatgggcgtnccctggggttgggggggcacaaggttttggaggaagaagacaacttcctcattccatcatcaccatctntttctcactang

SEQ ID NO: 126 - DNA, 4463 bp, Homo sapiens
  misc_feature (3308)..(3308): n equals a,t,g, or c
  misc_feature (3469)..(3469): n equals a,t,g, or c
  misc_feature (4119)..(4119): n equals a,t,g, or c
cagcaatgaaatcctgctttcttttcctcagaactactatattcagtggctaaatggctccctgattcatggtttgtggaatcttgcttcccttttttccaacctttgyttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagatccttggagttctttttctgtgcttcagtctcctgtctggcactttgctgcacagactccagctgacatagtctccccagattcccatttcatgctctcaactcaagggatgagctgggctcagcttgtgttcctccttcctgcatcacggcctggaaactctcaagacaagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagccaagccttctgtaaatgggcatcagaaagcactgtgagacgcacagacggcgtcttctgccaccaagagaccgagaactccagattcacgacattcctgtcccatgtagaagcatttccattcawccgtggsccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctgcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggntgctgcgtaatcacggttcctcgaggctcttcctgagcacatgcccaagcatctgcctctggagagactgactccaaatgcaggtgcttccattggagctaggtcggaggctgctttatatgacgaactcccagaaatggatgcccagaatacggaggccnaaacgttctgagcycctggtaaggacagtcgctctgggggtcctcattttacctgcagttcctgcacgcccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgnacctcgtctgccmrgggacacaggttttcatcatttacaggstcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcaaaaaaaaaaaaaaaaaaaa

SEQ ID NO: 127 - DNA, 1477 bp, Homo sapiens
  misc_feature (7)..(7): n equals a,t,g, or c
tgcaggnaccggtccggaattcccgggatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcaaaaaaaaaaaaaaaaaaaagggcggccgc

SEQ ID NO: 128 - DNA, 1984 bp, Homo sapiens
ccacgcgtccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaacacttaatgtattctgacatgagtgctctaatagcctccttctcctcatttttaaactgcatacattactttcaaaataggtatagatattctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattatgataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaaaaaaaaaaaaaaaaa

SEQ ID NO: 129 - DNA, 3447 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggaactaagccggaggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagatgaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagcgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaggggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtgaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcaaaaaaaaaa

SEQ ID NO: 130 - DNA, 1513 bp, Homo sapiens
  misc_feature (1463)..(1463): n equals a,t,g, or c
  misc_feature (1490)..(1490): n equals a,t,g, or c
  misc_feature (1503)..(1503): n equals a,t,g, or c
gggcctcagggaccccattccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacatttgtaagaaanggggtaagggacacagctgggcaagtngattggttggcangattgctgtc

SEQ ID NO: 131 - DNA, 1166 bp, Homo sapiens
  misc_feature (1)..(1): n equals a,t,g, or c
nccttctctaaaaaagcaaacaggcaaaacttcatgagaatcttgatcatgttaaaattttatgtccttcgatttctccctacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagatagaaaactacccctgagtgtggtcccacaggatatgtagagaaaatcacatgc

SEQ ID NO: 132 - DNA, 2312 bp, Homo sapiens
  misc_feature (2312)..(2312): n equals a,t,g, or c
gcccttgtaggtgacactatagaaggtacgcctgcaggtaccggtccggaattcccgggtcgacccacgcgkscgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaaaaaaaaaaaaaaaaaaaaaaaaaaaaaaaacaaaaaan

SEQ ID NO: 133 - DNA, 6107 bp, Homo sapiens
  misc_feature (5749)..(5749): n equals a,t,g, or c
  misc_feature (5892)..(5892): n equals a,t,g, or c
  misc_feature (5896)..(5896): n equals a,t,g, or c
  misc_feature (5906)..(5906): n equals a,t,g, or c
  misc_feature (5957)..(5957): n equals a,t,g, or c
  misc_feature (5966)..(5966): n equals a,t,g, or c
gcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattcctgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaattctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttanctaccattctgccatttttaatttttatttaattttatttgcttgagcacactgatcaaccactgaactgccttcttccattgtcctgcaatgatataagggttacatttttgtgtatatggctttcatagttgggatttcanagcnctgataccanatattttcagtttgttctctgggggaatttcatttgcatctatgtttttanctatctgtnataacttgttaaatattaaaaagatattttgcttctattggaacatttgtatactcgcaactatatttctgtaaacagctgcagtcaaaaataaaacactgaaagttttcaaaaaaaaaaaaaaaaaaaaaaaaaaaaaaa

SEQ ID NO: 134 - DNA, 3037 bp, Homo sapiens
aattcggcagagcctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcamgccttcamctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcgcttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctyccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctaaaaaaaaaaaaaaaaaaaaaaaaaaaaaaaaaaaaaaaaaaaaagggcggccgc

SEQ ID NO: 135 - DNA, 767 bp, Homo sapiens
catgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgygtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaaaaaaaaaaaaaagggcggcc

SEQ ID NO: 136 - DNA, 1932 bp, Homo sapiens
cccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatycggaactacacccgcttcgatgactggtacctgtgggtwcagatgtacaaggggactgtgtccatgccagtcttccagtccytrgaggcctactggcctggtctkcagagcctcrttggrgacattgacaatgccatgaggaccttcctcaactactacactrtatggaagcagtttggggggctcccrgaattctacaacattcctcagggatacacagtggagaagcgagagggctacccwcttcggccagaactyattgaragcgcaatgtacctctaccgtgccacgggggaycccaccctcytagaactcggaagagatgctgtggaatccattgaaaaaatcagcaaggtggagtgyggatttgcaacaatcaaagatctgcgagaccacaagctggacaaccgcatggagtckttcttcctggccgagacygtgaaatacctctacctyctgttygacccrrccaacttcatccacaacaayggstccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcaaaaaaaaaaaaaaaaaaaaaaaaaaaaaaaaaaaaaaaaaaaagggcggccgc

SEQ ID NO: 137 - DNA, 1256 bp, Homo sapiens
  misc_feature (1079)..(1079): n equals a,t,g, or c
gggacaagtccacgtatatcgagtcctcgaaggataggcgggggaagattcctgccaccctgtgctctcggtccagccggacgtccatgaccttgggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcncccctacgggatgcccacggccgttcatcatcttgtccctcgtccccctaccacactccccctcctagaccgccgccctttaacacagtctggatttaataaattcatatgggtgtttaacttaaamwmaaaaaaaaaaaaaaaaaaaaaaaaaaaaaaaaaaaaaagggcggccgc

SEQ ID NO: 138 - DNA, 2683 bp, Homo sapiens
  misc_feature (2640)..(2640): n equals a,t,g, or c
  misc_feature (2676)..(2676): n equals a,t,g, or c
acaasgtmacgcctgacaggtmaccggatccgggaattcccgggtcgacccacggcgtccgcatttgcaataacagaaaaggaattgcatgtatgaagttttcaatcgtgggcttttctttgttgtggggagggggtcgggggatagtttgatttccattttctgaaaacgacagacttggattctgtttgtgtgtgcatattttatccagccttaagttataaagctcatctgtcccgctgcattccctgtgtattttcaggacatggctcgtgggtgtgtgtgttcattgtgtgcgtctgtatgtatttttctgtcatcactgttccctctcctcccgagtgtgcattcagttaatataatcagttgcttgcttctttcaaagtgctttgaaggtcttgaactcatgtgtgagcatctttatcaactatcccaattgcatgttctccatcacatattctcttatttgctctgtaccccctgagaatatgttttagagatattggaataaagctgtctgggtaaggagtaggcttagccgacctatgaataatacactttagtctagttctttattctaaatctggattgccagtattgtgtatttaaaccaagtctgtgaatacctgctttttttggccacagagtaacaagttttcatgtaagatcttcataccaaagtaggaagtaaaaatagcttagaaagctctgtcaggtgttttgtgcagctgacagargtaatgttacatcacctaaaaaagaaagatacacggtcagttatcctaaaaataaattgtttggaaagtacaatgcaccacatttttgtagaagtctactatttgataaacagttgaaattcaagatgtgtttgacccttagtcatttttactctttggttctgagtatacctattttcttagcgtatctgccttgtttatctttttcttcaccttttaacaagtatgacataggaaagtcatttttttttagaattcatggatcagtctgatctactcttattcataatggaacatgtaaatatactgaaaactgtttttcaggagagaaatatgagttggagggaaggaaaagtggttctactaatgttccaaaatcctcatcagagaaggtatgatgttctcaggtgtggaaaatattttttagttgattgagaatgcaggtttaacagaagagataaggggcataatgactgctggttttccagactggattttcctaccgcaactattaatgttctcagagttgatgaggaccacctttgtgtatacacttgtagttttaaaccttgcattggtaacaaaatgatcaactttaatccaggtagaattcaagatggctgtacttcagttgtatgataaaattaatggttctcatgacttgtgtggcatctaaaaataatgtttttatagcatctctctgccactaaattgttgacttgaattttgggaaaaaaaaaagttggtgttgatatgtatatgtgtgtgtgtatatatgtatttataaacaagtgtgtttgagtaacaagtgagtttcatagtcttcccctacgcatgtgtattccacacacaaatggctgagttatagtcataaaacaatttgcaataaaaaaaaaaccaaaacagattgtcagttaaccaggaaacagttaatgttttttaatgaatctggcattatagtgagcaaatgtcgtattaatttaggctaatttctaatactaccataatttgtgtctaaatttctgttggggtagaaattactaaaattgtggggagttttttctgatttttacattgctttaggaaacatttttactaattcagctgtcttaggtaaaatgaatagttttcttcctgtttttttatgtgtcattgttagtggtctcagaattctgatcagtaactttgtgtatgatgctgaattacaaaccgtttgaatgatccagttgaaaacgtatccctctactttcttcagttgtagaaaaggttaatttccctcagtgtcccacattataccaacctaagagaagaacaggtaatagggagaaataaacatacggtggtttcagtggttttggtcatgtgtccacaggagaaactaaccattcagttgtcttaattttagttcgttctaccctgtgaggagtttgtttccatcagttgttgactttccaaaatgttgcattaagtaatagttgtcactctgttggtctcatggtcaatatcaatcagactttcatgatctctactaattattagtagagtcctgtactatgtctgtaactactaagtttaaagaaaagcacatagtcacttcatctctttttttcttagcctacgctcactccccaacccatcccaacattgacatgctatctgtggacaaatagcagttctcagaatctagtcaagttgccatcatcccccttgccttggccgttcatagtaggtatgcatatgtttgtttctgtacagtactgtgtgtgtgtgtgtatatatatatacatctgtatgcacacatctttgataaaatagctatttgactagcagggttaaagtggcttttaattacttcgtgagtgttattggatacatcttaaaaaaaaaaaatctggacccaganccatgccatacttggttggactattttggggcattnaaaattg

SEQ ID NO: 139 - DNA, 703 bp, Homo sapiens
ccacgcgtccgcaggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaa

SEQ ID NO: 140 - DNA, 3881 bp, Homo sapiens
ccacgcgtccggcacaacgtgcaggtttgttaacatatgtataaatgtgccatgttggtgtgctgcacccattaactcgtcatttagcattaggtatatctcctaatgctatccctcccccctccacccacccaactcctgggctcaagggatcctcccactcagcctcctgagtagctgggactacggtgtgtgtgactctgtgggctctattttctgtttttgttcgtttgtttgtttatagcagccatactaatgggtgtgagatggtatctcattgtgttggtttgcatttccctaataattagtgatgttcagtattttttcacatgcttattggtcatttgtatatcttccttggagaaatatttattcaactcctttgcccattttaaaatcaggttatttgggtttttgttgttgatgttgagttgtaggagttctttgtatattctagatattcacccctcatatatatgatttgcaaataaattctcctgttctataggttgccttttcactctgttaattgtgtcctttgagtcatagaaatttttgatggtaatgtggtctatcttatgtatttttacattggttgactgtgctttagatgttatatccaagatataattgcaatctaatgtcatgaagctttactctcctatgttttcttctaagagttttagagtgtttagagagtttaagagtgttaggtcttatattcaggtctttcatttattttgagttaatttttgtgtatggaacaaggtaagggcccaactttattattttgcatgtgtacttctaggttttccagcatcatttattgaagagcctgttctttccccattgaatggccttggcatcctcatcaaaaatcattttactatatatttgaggggttatttctggactctgtaccatggtctgtatgtctgtttatgccagttccacactttttgattactgtagtcttgcagtatgttttgaaatcaggaagtatgagacctccaacttgagtgtcttttgaagagaagatgttcttaatggtggtgcagtcttactgtcagtttttaaaatggattatagttttgatgttgtatctaagaagtctttgcctcacacaggatcacaaagattttctgctatgttttcttttataaatgtggtagtatgaaggtttatacttatgtctgtgatccatttggaattaatttttacatgtggcatagtgtatgaattggagttcaattgtttgcatatggttctggcattatttgttgaaaagactatcctttcttcactgtcattgcatcttgctgaaataaactgacactgtatgtgtgggtctatttttgtctgtctcttctatactgtgatctgtttgtgcttataccagtacttagattactatagcttataaagagttttgaacgtctggtcagtaaagtttcaactttgtacttttttttcagagttgttggcagttctggtgatttagatttccatttaacttttagaatcagcttgttaatttttaatgacaacataaaaggcgactgggattttaactggggttactttgaatcctcagggcaatttgtgggaaattgtattttaatgatactgattcttcgaatccatgaagattgatatctctccatttatttaggcattttcagtttcttccagcaatgctttgtggtttttcagcctacatgtcttggatagctttatcagatttattcctaagtatttcttatttttttgatgctattgtaaatgatactttaaactttatttctggaataattgtagatcatatgtagattatagttgcaaaaataatacagagaattcccttatattccttacctattttgccctaacatcaacatcttatattactatggcacatttggattttatttggattttatccctcttccacttaatatctttttgttgttgttgttctagagtatcacttttaggcataatgtcttcctggttacctttgatctatttgtttctcagtcttcattttttacaaccttgacagttttgagtaatattctttaagaattttgtagaatgtccttcattttgggcttgcctggtattttttttctcatgttttggtcatcttttgtgagatctctcagtaagtatttcttattttggggtgctgttataaatggcattgattgttaaattttaatttttagtttttttgttgctagtttatagaaataagattgattttttatattgaccctatatactaaaacttattagctccaataagttttataaatacagtccatagattttctacttagacaattaggttttttttgcaaattaaaagctttaattcttgtggtctgtatttccttacagtattctttccaaccaagtgtacctacttgttgctttaggattagtttttgttaggcagaagatctgtaagaagcttcctagcaaggacagaaggtggcctcagaatcaagatatcatcatgcccacgtatgtcttgtttgtatcaatcacctgtctggtattatgttagcctactctgtcctgcccttgagtactttagtctgtctgccttgcttccaactcactgcttcactgagaccttttatccaaagtcacagtattatttcttggaaaagttcctgtaaaaagtttctagtcaaattgcctgggaaaaaaccctactacttattgagtgcttacttgattttagacatgttctttcggatattttagttatctttaccacgacgcattacacctctagttaagtagtattattcatttaacaacaaaaaaatttatgcctaccttatgtaatgctatgtggaaggttctatagctccagcaatgaaccaaacacacccagaaaggcaagagagtacaataccaatcgcaaattgtgatatctattctgacgggaaggtattgaatgctacaaaatgatgagtctgacttagtctgcagggatagggaagacgttttcgaggaaatgattaaaaaaagtgaaggaagagtaggaattttcaagtgaagtagtggaagaagagtgttttagatggaagtagcagtagatgtgaagtttctgaggtaggagagagcactgacctttcagagagttggactgtgttaccattttactgatgaagaggctgaaagatacagagaggctaagttatttcccaaggttgcatagtaaatggagggagccagactggaacccaggacgatacagcttttatcagttaactatgctatttgaaagtcaaaataaagtaatttaaattgaattccccatagaaatggagaattcgcccatttctgaataaaaacaacttaaaatgtcctattacaggttataaaatagtctgtttaaatagtctataatgggtcattatataaataaaaatgcaattgcaattttttggtaagtttgaaattttacaaatttttagaaacttggtattttaaaagtcctgacctgtagtttgtcattgattaaggaaaaagctaggagcgccttacttccttggagtttttgaaaaagtatgtgtaagaagctagaaatctgcagtatacagagtattgtgatattgttaattgtaatttgcttattttcactgtaataaatgaccttcaacacaattattgaatttttaaaaactttctttgaataggcttttgccagcattttgaggaatgcttggagttgagctacttgatggcttctagaaactgacccacagttctctgtgtggttgtcctgagtttttcattttcattcatttaagaatttcgtttaatatgttcatactgttctgtccattaaaaaaaaaaaaaaa

SEQ ID NO: 141 - DNA, 2687 bp, Homo sapiens
  misc_feature (1614)..(1614): n equals a,t,g, or c
gtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtgcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaargacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtraccttaggactggctccacagggtggactggctgggccctggtcccagtccctgcctggggccatgtgtcccccctattcctgtgggcttttcatacttgcctactgggccctggcncsgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcagctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcasgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaaaaaaaaaaaaaaaaaaaaaaaaaaaaaagggcggcc

SEQ ID NO: 142 - DNA, 728 bp, Homo sapiens
aaatgatttagtgacctatacaagtagcctgcagtaccggatccgaattcccggtcgacccacgcgtccggtgaaaacagcagagtgctactccataccactgggatcttgtccagtaaacatccagagagtgaggttaggaaataaaaagtatataaatattagatgcctagaaatgcaagtcactttaaagattttatgtgaaatagaaaaaaaagagaggagagggactcattgtcttgtaatgggtccttcccagagagaggtgactgtccagtggcaccgggcccttttcctccttccccttttactcttatcaactaggacagaaactaagaattttggcttcaagtggctaaaagactgatgggggaaaaaagaaaatagaaaaaaataacagagagactgacgctctaggcagttacaagtccaagaaaaaagacagaaacttttaagtattgagccaaaaccaggtctagcaamcataatgctggccctagattatttattaatttatgaagaaacttctagatatgggggtgacaaaaggaaattaaatccattatatatgcatatattttaatgtaaatatataatagataaattatgtatacataatatataaccaaattgaaacagttttacaatttggtttgactggaaattcaaaatccatatattaatttttgtagtaaaagtttatgtaaaaaaaaaaaaaaagggcggcc

SEQ ID NO: 143 - DNA, 986 bp, Homo sapiens
gcactggcctcttcactggtggccgagaaccagggctttgtggcagcactgatggtgcaggaggcaccggccctggtacggctgagcctggggtcccatcgggtcaagggcccactcccagtgttgaagctccagccggagggctggagcccatctactctctggagctgcgcttccgtgtggaaggacagctgtatgcacccctggaggctgtccatgtgccctgcctgtgtcctggccgccctgcccgccctctgctcctgcctctgcagccccgatgcccggcccccgcacggctggatgtccatgccctttacaccacatccactggtctcacgtgccatgcccacttgccacccctgttcgtgaactttgccgacctctttctgcctttcccgcagcctccagagggggccgggctgggcttctttgaggagctctgggattcctgcctgccagagggtgctgagagtcgtgtgtggtgtccacttgggccacagggcctggagggcttggtgtcccgccacctggagccttttgtggtggtggcccagcctcctaccagctactgtgtagcaatccacctgcccccggactcaaagctgctgctgcggctggaggcggccctggcagatggagtgcctgtggcctgcggaccgatgactgggccgtgctgcccctggcgggggactacctccgtgggctggcggctgctgtctgagccccgggagaccaggtgggggcaggactgtggcccttgtgggggccaaggcacactcctgtagctctgtcgccaaaaccctgcattccgcagtgccctcgctggcttgttttcttttgggccccggttgggagcaggctcctgggggtgagggtctgtctgagtctgtttttgctgctctagcaagatccctgagacggggtaagttataataaacagaaatgtattggctcagaaaaaaaaaaaaaaaaaaaagggcggccgc

SEQ ID NO: 144 - DNA, 1635 bp, Homo sapiens
  misc_feature (85)..(85): n equals a,t,g, or c
tcgacccacgcgtccgcagctctccgtggacaatgggctgtggcgtgtgaccctgtgcatgctggccttcccgctgctcctcacnggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgargggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggartaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgc

SEQ ID NO: 145 - DNA, 1410 bp, Homo sapiens
gcccacgcgtccgagaaaaatgctgctcagtttttattgtctaccaatggtaagtatacatattttctttccatgtgcccactgtgtgtacctgttgcacatatcctgtagcctaggagaggaatcatttaacagagatacttgtaaaaaggacttttgtttttctatacagaatgtaaactctacttttttactgtcacttgcagtttttagattctctgaaagattctctgatagcaattttttgtttactacacctccaatttgtagtgaaaagaatgggctgctataccattggatttaggtcaggtactatttctgtcatttctcagtctcgtaatcttgggcaggttactaacactgaattgaattttcctcagcagcaaactagagatagcaattttttattatagtattattatgaatattaaataacttcacatacatcatgagtgcaagtgctcaataaatgttaatttattcctcctttttaagtgtttgtaaactacacagagtatctcaaactgcagatacaaaatactcaaaggatggtctccattccaggatacgctataggagagcactttcttacttgatcaccattagcatattgccttcttcccagcaatccacatggctggaaggagattcctctcctactgtttacttgccaagggaacattttttgttgttttttgagacaatgtctgtcgcccaggctgaagtgcattggtgtaatcacagctcactgcagcctcgacctccctacctcagtctcctgagtagctgggaccacaggtgagtgccaccacacccggctaattttttaaaaacatttttgtagagcctgggtaacatggggtggaacaagcctgtagtcccagatactcaggaggctgaggtgaaaggattgcttgggccagggaggtcaaggctgcagtgagccgtgaaaggccactgcactccagcctgggtgacagaatgagaccttgtctcaaaaaaaaaaaaaaagtttcttggaacctatacgtttttttttgttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttgaaaaaaaaaaaaaaaaaaaaaaaaaaaa

SEQ ID NO: 146 - DNA, 1727 bp, Homo sapiens
  misc_feature (979)..(979): n equals a,t,g, or c
  misc_feature (1047)..(1047): n equals a,t,g, or c
  misc_feature (1135)..(1135): n equals a,t,g, or c
ccacgcgtccggccatggttgccactgtctgtggcctcctggtcttcctgagcctgggcctggtacccccagtccgctgcctgtttgcactcagcgtgcccaccctgggtatggagcagggccgccggctgctcctgtcctacagcactgccaccctggccattgctgtggtgcccaacgtcctggccaacgtgggtgcggccgggcaggtgctgaggtgtgtcaccgagggctccctggagagtctcctcaataccactcaccagctgcatgcagcatccagggctctgggccccacaggccaggcaggcagccggggcctgacatttgaggcccaggacaatggctctgccttctaccttcacatgctcacggtcactcagcaggtcctggaggatttctctggcctggagtccctggcccgggcagcagcgctagggacccagcgagtggtcacagggctgtttatgttgggcctcctggtggagtcggcatggtacctccattgctacctgacagacctgcggtttgacaatatctacgccactcaacagctgacccagcggttggcacaggcccaggctacacacctcctggcccctccacccacctggctgctccaggcggctcagctgaggctgtcacaggaggagctgttgagttgtcttctaaggctggggctgcttgccctgctcctcgtggccacggctgtggcggtggccacagaccatgtagccttcctcctggcacaggctactgtggactgggctcagaagttgccaactgtgcccatcacgctcacggtcaagtatgatgtggcatacactgtcctgggcttcatccctttcctcttcaaccagctggctccggagagccccttcctctccgtccacagctcctaccaatgggagctccgcctcacctccgcccgctgcccactgctacccgcccggcgtccccgcgcagctgccccgctggncgcggggggcctgcagctcctggcgggctccacggtgctcctggagggctacgcccgccgcctgcggnatgccatcgccgcttccttcttcacagcccaggaggcgaggaggatccgccacctacacgcccggctccagcgaagacacgacaggcnccaaggccagcagctgcccctaggggatccttcttgcgtccccacacccagacctgcctgcaagcctccggcatggatagcctacaggctggatgccttaagaaccgagagcagtgagggagaagggaaagagctttggagttgcagagacctgagttgtcaccttggtcctgtgccgcctccctgtgtgaccttgggtaagtcacttcacctctctgagcctcggtttctacatctgcataacgacagcatatttaccattgatgtgacctacttcccacgcagggatgtggtcaggatggaaggaaatactgggcatgataggcctggataaccggtaaagaaccatgcaaaggcgaagacaaggagtgcagagagagctcatggttcctccaggctggttggcgatcaggctcatctcatctgcaccaactgctctacttgttagatggagaccttgcatcatgaatttctcgaaatgctcctggaacttatttatatgcctcaaaatcctctaaactcatttatagtaacccatagttttaattttataaataaacgtatttattaaatcttaaaaaaaaaaaaaaaa

SEQ ID NO: 147 - DNA, 1353 bp, Homo sapiens
ccacgcgtccgcgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgatggggcgcctacccttcttcagcaagatgggaacagctgagtctgaaggaagagaaacactgacacagcagctgcctctcccagcagccgccatgagaagattgttacctgcaagcagagtgtccactcaacccgtgctgaggctggcagacagtgctgagtcacttctgggcaggcctgctctgtgggctctaggattcctgctttgccctccctctcaggcacaatgacaactactgctcagtgccagacactgcaccatgtaggcaacacgtggcagtgatgattagtcacaaaatcacatttatattcattctaatgaaactgccattgcaaaattataactgagacagtgaaagaagtctgacctaaccaactccatcttgcttctaacctccaagctgtccttgttcattcctgggactcattttgggaggaacttagttaatagcttacagtttaaaacaaagacaatcacagacctttcccaaaacaaacccccttcttgcctggaaactagactgcctttgtaggattaacaaattagccgaaagattagaaattatggtttaggagtcacgcagctggagatgacaagattctgacactcctccaattgctcctggggataacattactattctaaggcctaacatcagtgcttgagatgttttgtagaccctgcccttgatggatcagctggtactacccagaccgataaactggctcgtcttatcttgtggcccccacccaggagctgactcaatgcaagaagactgttctgactccctatgatttcatctccaacccaaccaagcggcactgtcaactcactggcctccccctacccaccaaattatccttaaaaactcagatccccaaatgctcagggaaactgattatgattaccccaaagcttggagtaataataaaactggcctgtctcccgcacagccaaaaaaaaaaaaaaaaaaaaaaaaaaaaaaaaaaaaaaaaaaaaaaaaaaaaaa

SEQ ID NO: 148 - DNA, 2504 bp, Homo sapiens
tcgacccacgcgtccgcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaagttggagccattgtgaataccattgggtamtatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcmgcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtargggtgtgtgcstgacgtactgcarcctyaamctyctgggctyaagtgatcctcccacctcagcctcctgagtagctgagaccacaggcgtgtgccaccacgcctagctaatttttwawaccrgggtcwamcctttgtttcccaggstggtyttgaattcctgggatcaagcaatycttccacctkgsmctcccaaagtgttgggattataggcatgagccaccasgactggccagaggacaaaattttaataaaggtcttagcttaagcagtaatcytacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagaaaaaaaaaaaaaaaaaaaaaaaaaaaaaaaaaaaagggcggcc

SEQ ID NO: 149 - DNA, 1655 bp, Homo sapiens
ccacgcgtccgggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcatagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctattggtgaatcgtgcccagggtgggaacctaaattattctgcaagacaaaggaagaaataaaatttcccatactgaatgagaagttaaaatgaatgtgtcagagaatgggcttaacacatcgttggtttgaaaacttccattttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttttgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaaaaaaaaaaaaaaaa

SEQ ID NO: 150 - DNA, 1905 bp, Homo sapiens
  misc_feature (1)..(1): n equals a,t,g, or c
  misc_feature (1828)..(1828): n equals a,t,g, or c
  misc_feature (1837)..(1837): n equals a,t,g, or c
  misc_feature (1846)..(1846): n equals a,t,g, or c
  misc_feature (1860)..(1860): n equals a,t,g, or c
ngccacagcagagacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaagccgtgtggtccagcttnccccgtggnttcaattantttcccaattttgnctgcattcggaaccattagccctgcaatttagcaggggcaagccc

SEQ ID NO: 151 - DNA, 2406 bp, Homo sapiens
ccacgcgtccggaatgaacaacttttcttctcttgaatatatcttaacgccaaattttgagtgcttttttgttacccatcctcatatgtcccagctggaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctgtgaatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaaaaaaaaaaaaaaaaa

SEQ ID NO: 152 - DNA, 2080 bp, Homo sapiens
  misc_feature (145)..(145): n equals a,t,g, or c
aattcggcacgagacctttagggtgcgcgggtgcagtatatctcgcgctctctcccctttccccctcccctttccccaccccgggcgctcaggttggtctggaccggaagcgaagatggcgacttctggcgcggcctcggcgganctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagawgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaaaaaaaaaaaaaaaaaaaaaaaaaaaaaaaaagggcggccgc

SEQ ID NO: 153 - DNA, 6297 bp, Homo sapiens
ccacgcgtccggtcagctttcatctcgtcctatctttgttcaggcaaacttctctagttctgttttaataggcatatttgttaggtctgttttttgaaatcctcttttttacattgtttaaagataatgccttggctaaaaagcctgcttcacttttccctgtttttagttgttttctccacattggcagtaaagagccttggcgtcccagtagcagcaggttctcctttttgtattgtggatgttttgcatttcatactgttgtgaagagtggctttgatcatacatgttgttggtatatttgcctttttgctgggggtgtgagaagaaccagagatgagcagaggtacacccagtagacttcccagcctgcagagcctcccgggaagagcttccgtgttcaggtgcttggggccccaccctaggagcctgactcacagtcagagcagggtcccggcttgtgttcaggattttgaaacatttgtaaggtgattttgttgtttctacacctttctcctcatctttttttttttgtagttaatcgttactaataacagaaaagacatttttggcatggtaattggcacaaagtgaataattgttgaatagatgacttttgaggctttcaaaattcgagtgtccataaaatccatccagagccacctggttcctttttttgaaccacttaacgtaattctggaaaaccttgactgtgggtcttaagtttggtggattgctgcttctcactggctgacctttggaggtcgcatatttcaggatgtgattccacttaggctccatttcacctgacactgcaattctgtgccttcagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaacctttcctcgagaactttcattctaaagagtaggtgcagcatcactgaagtagagtcaagtttcaaagcattcacgtgtgagtaacttgaataaatactacatctggttatgccaattagaatcaatttcggagtgttatttcatgacacatttcatgacaagtggcatgtttattcctggcagtggaaaagtttttttttctccacgtacagaaataaactcttttactctcatccctgtaagggtagctttgctttttttttttttttttaaattgggccgggattcaagccttgtttccaatatgaagtaattcattacaattttaggccagaaacagcctgaggcttgtttaaaaagaaaaaaactagatggaaaatgttattttataatgcttgtcctggtttttagaataaatgtatttcatctttgtttttaacagaatttatgtattaataatttggggattttctgtaaagattgttttgttttgtcttggcaaataatcttcctatctttggagtgaatgagaatcaccatttgtcacctttgagagaatggatactcctgccctgtgatttttgttggtattggatagtgctagtaatctggaatgtaccctgtggttctgcaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaaggtgagtttttctttttccaaaatgacataacatttgatcttgtacatttaagacaaaaactaaccggagtttagtagaagtacagaggaaagaggagcttcttgctgtgggcagcaggagagctgaccctgaatgagggggaatttcatttaaatatcaagttttccaaaaagcagaaatttctcataggtgataggtaagtggagaagtcagtgtttgggggaatgtattcctgccacactgtaaatccagttatttaataaaaattgaaaagacatgaaagattgctctgtggctctcaattggaagccccaggtttctgtgctctagttccttgtgagtggttcatttcaccaattacagatagcagagctctgctgaccccaagccagcccgggttcaccttggctgcaaggaatgatgacggccttgtccagacctggctagaaagatgcagcccggcctgtttgctatggatctaaactgcctgctggttcctttccaaggcaggccaggaaacagtggtgaaggagtgttgccctcatcctaacacgcagtcctttgtaatgcgtgctgtctcacctgtatcacgccagcattatttattagttcataaatcagccttccatgatgaaagaacctggcctggaatcaaagtctggaagtctgtatttctttaagatccatgcttgaaaattaggacaaaaaacgcttagctttggaggaacaaaaaggaaacagttccgcaaagagctccagcctttttctggggcacggtttgtgcagtttaacgttggaacgtacagcctcagacgggcaaagggggcgactgcacttctgccgccaccagggtttttctgtcaggttagaaagtatttcactttgaggctaaaagtctcacaaggtatcttaacgctgatggaatgttattttcatggaatcagtataagaaattatattgtaaagtattagatactttgcattcattcatactaggtttcagtagcttgtgttttagactttgcgcttgtcacattttaagtggtcagtgaccacaggcttgtggctgcccagctgcagagcacagtgcagtcacagaggagcctgtcttagagacgcgtgctttaggttggcctgcattagggcttacattgatgtttctgacgtgttaatacttacatagaaaggttttgacattttttcaattagccccttatgtatagtcttactttttagaacaacttattgtcattttctcgtttaaataatatgaatacttctctctttctgttactatgtcagtttcttattcacttagttcaacagatctagtgctagcatggcctgtgctgctgttggtcctactgggaacgcaggtagagtctccatggtcaggatgccgtgttctgttgtggtgctgaggcctgtaagcacttggctagaagttaggccagggaagctcacactgaccttggtatttgaaggtcccagaatgaggttgttgaggtagaacagagatgggagaacatgcccttggagctggactcaacaagaaggcccctctgggggaagctgaggttggacaggaagggcgtgtgccctcactgacttgctcacaggcttggggttcatctgttttggtttttgcttttttacattatattaacatggaaataaaaggtgttccctgggatgctcccggcttctctgctcagtagctttgtggctctgagtaaaatgaacttgcctgtgttgaaatatcctaatttttaaacttacttcatagggactgaggaattacgacttttatcaattttgtgacctgttaaaatgttaaaaaggacatgtattttttaaagatctttaagtaaaacattttgctcattcccaaagccaaatttaaattataccatggccctaattcagaagttcattctttggcaggtgtttccttggtgcctggggcactctctctttctcccagttcctgtggcagtttgtccaggtgcccaagaacaattcataccctcctttctcgttatttatatacttgtctttttgcccctgccgggtattttagaaatcgtgcttggtgcactttgtgtccttcagtgtgccttacccagagcagatgcacgataagcatttttacacgagaacaagctggtggtgtaggcctctgctaaggaacaggctgtatatgctctttgtgggattaaggtagaatcagctttaactccaaagaaactgtccatgaattttgtttataatagcaagtagatttaaaatgacactttgaaaaaattctgttgtctttctctacatataatgctgtagaaaaatataactgatggattttgtgaacgtggtatttttaacttttcgtagcagcacaaagaatgctcctctttgtgtgtcaatgaaattgttctttatgacagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtgggtaagaaaagtggttatgtcttgatctaatacgctggtgtcttcacagtccttttggattaaatgggatcccagagccacttcttggtcggtttgagggggcagtacatgtgtggtatcaggcacatgcagtgtgagggctggactctgtggaagccggaaggtttcaacatctgccgcaaaccgttccatgttgcacagaactgacagaaaggaagaatgtgcttttggtattgaaggttaccacacattacagattgatttgtctcatcctgattccctttttagtcctcctccatcaaagaaaatgaagttatttggatttaaagaagatccatttgtatttattcctgaagatgacccattatttccacctattgagtaaggattcagcctttttaattattcatttaaagaaatttactatagagtatcaaatgtacaactgatcacatgtaaccattgttttgtatgtagttctgtctagctttttttttttttttaacctttttaactgcatattagagcaggatgaaactttagaggttactcaatcttttaatttaaggagaaagtaaacttttactttgtgaacatgatagataaaaaaaaactggaccgggcgcggtggctcacggctgtaatcccagcactttgggaggccgagacgggcggagcacgaggtcaggagattgagaccatcctggctgacacggtgaaaccccgtctctactaaaaatacaaaaaaaattagccgggcgtggtggcgggcacctgtagtcccagctactctggaggctgaggcaggagaatggcgtgaacctgggaggtggagcttgcagtgagccgagatcgcgccgctgcactccagcctgggcgacagagcgagactccgtctcaaaaaaaacaaaagaaaactggactgtgattatgaatctaaattagttgtgatcctgaacctaaattactcaattgagtatatagacgagtagccaaggttgtctagttcagtttctgtagaagaaatgaagagcagcatgggtgagggctaattagggatgacatagacagaatatagaggaaaagggtttaggacaagtctgacattcatctgtttcttattcattgaattttagaatctatttaccagggcggtcacttactgtcttttttaataactggtcctttgcatacatttgtaaaagtctattaaaaaataagtctcagccgggcacatcccagcacttggggaggctgaggcaggcagatcatgaggttaggagtttgagaccagtctgaccaatgtggtgaaaccccgtctttactaaaaatacaaaaaaaaattaggtgtggtggcgtgcacctataatcacagctgctcaggctgaggcaggagaaccgcttcaacccgggaggcagaggttgcagtgagctgagactgcgccactgcactccagcttggaagacagagcaagactccatatcaaaaaaaaaaaaaaa

SEQ ID NO: 154 - DNA, 3408 bp, Homo sapiens
ccacgcgtccggaggcaggaccttgtcctattcattaatcttgcccctcaacagttattttcagaggggcaagaagtgtttcagggttcttggcccttgtttgaccagtcgtcctaaccctcatgtcttgggtcattgttgttataatctggggttaccttttggaaggtcatggggtacccttttgcaaaagttatgggccctctccttggaaactgcacacacaccatgcagcttacaattcagggagttcacaggtctacagaatcctggaaactctcatgtccggttctactcattgtagcttcagtggaaccttctagcagtcctttccagctcctccccagctcctcagctctgcttccctccgcccatcaagccctcctcagcccataaggtgggccaggtggcctgtggggataaatcagagtgcccacaagtgcaggggcccaaagacatcccagagcaaacccaagaatccctctacaagccccagcccactcagaaggatgcattttgccccctctgtttatttgtttgtttttaattatgaaagtagggcatggtcattgttgagaatgtgagaaatgcagagaagttaaaatgatgctttttgtttagggcgctgctgcttctggcttaagatcctaaatcaaagcagctgccagatctggacctaagacttgcttcccatcaccttacataaaagaaagagcactggactaggaatcaaagatctgaattcccatcaaatctctgctattactagcttttatctctatttatttatttatctgtctatctatctagtaccttttgtgaatatgagtgtttctcaccgaggccctcccatctctcttgcccccgatcctggaatggaccaaataccttgtttactgaaggatacagatggcatgtgactgttgagaatcactcaccctcttagagccatggtttcctcttctataaaatagggatgttcgtgcctatttgctaatcatgagtgacaatgacataaggtacataaagctgtactgcatgatgcaaacataacatcatatttgtagggttgttgctaataatactatccatcagcaaagcagtcattcatttactcagtcaaatactgatgcactggtacattcagtttcctcttttgtaaaatggggataaaaataggacttagctcatagggtatttaagattcagtgagttaatatatataaaatacttagagcagtccttggaacatattaagaactcaatacatattagctagttgagcaggctgtagtatttgttccagccaagaaaagactgttctctaacagcacaggaaataaagatggggttaggcacgacacggcagcaggacttaccttctgtctaattcagctggcagtcaaagaaagaattattagaagcctatgagcttggtctcccaaagatctactgagtacagggggatatttaaagaataaaaatccctagacccacttacagtacaggagagacaagaagctgttcacacaataacaagtgctaaattccttgatttttatactgacagctgaagttttagagaagagaaggatcaataaagaccggaatattaaagcagacaggcctaaaagaggattttagatttgataaagaattcctccagttctcagagcagggactttggagggtaacaacttggatttcagtccttgcctgccacttactgattgtatgaccttggaaaagttacttcacttctgtgagcaatgattctctcatctggaaaacaaaacaaaacaaaaaaactaacaagggtgataataatacctacctccctacctcatagggctgatgagaagattaaaaagtacctacataaagcccttctctgcgtgcctggagcatggcaagggctccatgtgaaccactatttttttttttttttttaatgaaaagtcatgggcagcaccaaagctcagaattttggcagtaaggaattatgattctacattgaaatttgccagaaggggagctgactgcctcatgagacatttttgaatgaggccaaaaaaggaaacaagtgtatcctgggattttacgagatgctaggtatgtccttagcacttaatcctcatgactaccctatgatgtaagtactatctgttgtccctattttacagttggccaaggtcacatagctgaaacggacttctgtgtgtcttctaacttttgctttcaggtctggaaaaatgcaatgtaaacctagaccctctttgaaatactgaagatggtaatcttatcccttcctcactttctgttttctaaaataacagtccttgttccttacaatgtctgttttccagattcttagaagactttttgcttattttccataactctttacttgtgatccctgaatgacaccgggggtatagcagagaatgtccatttcctcaaagttcaaaggtcctacaaaaaatagttgctagcctggcatgatggtgtgtgcctgtggcctcagctacctgggaggctgaggcaggaggattgcttgagctgaggagtttgaggcgcagcgtgatcgcggctcaccgcagcctcccgggctcaagcattcctctcgcctcagcctcctgagtagctgggaccacagctccactaattttgaagtttttttggtagacatgaagtctccctgtgttgcccgggctggtctcaaactcctgacctcaagcagtcctcctgtcttggcctctggaaatgctgggattacaggcgtgagccactgtgctggcctcttttttctttttctttttttttaaggtttttatttgttaaatgggaagtctgtgccatcaactgagcattgtattttctccttagtaagagcctgggtgggccactgggagagaactatacattaaatgtaagtagcctctgggtagagagcccctggctggtttcctttcctttctctccttttctctactttggtgtctggaggcatttcccagactccagtttcttaccaccctcacggattttgctattgtattatcacctcctttatcattcccaaaattgactttatggagactcattaaaagaaagaatcatcggccgggagcggtggctcacgccacgaaggcgggcgaatcacctgaggtgcggagttcgtgaccagcctgaccaaaacagagaaaccccatctctactaaacaatacaaaattagctgggcgtggtggtgcacgcctgtaatcccagctactggggaggctgggacgggagaatcacttgaacccgggaggcagaggttgcagtgaccaaagatcgcactattgcactccagcctgggcaacaagagcaaaactctatctcaaaaaaaaaaaaaaaaaaaaaaaaaa

SEQ ID NO: 155 - DNA, 1663 bp, Homo sapiens
tcgacccacgcgtccgggcagtggggtgagggcacacaagcagttcagggtcccagcaggaagtggggctgcagggccggggtgggtcctgggcctggccatcaggcagcctagcaggttgttctgggcatggagggggcctggtgtggctgagggcatgcccagggctccctggaggatcccgctctgtgccctgcccaccctgtgcctggggagccctctgccctcacagcccacccaccccattttctatgaccacagagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgtaaggcttccccggggtggggtcctcccagccgtgggcctcagggtgaccgatcacagggagagtggctccctgccctgggcaccccctgcggtggccccgacgacagctgaggagtgaccacaaggtctctgcccacagtgctcggggtgcggtgtctgggctgcgaagtggatccccctcctttcttgggcactgcagcagcttggggggctttttggacgtggatgtgcctggtcctggtttcccgagggcctttacagtggatgaggaggtgaacacaggagtcctgagagcaagcaccacctcgggctttgttgtagaaacaatggcccggaccccaggccggagccgtggcttggcctcctgggtgtgtcttggcatctgaaatgcaggctacccacaccggctcacctccaggggtacaggcaggtcccacagggagagcttggcgctgagctgaggctgtctgggctcctcgcctcccaaccagtctgcagttacaggggccagtggggggcgggtgagaaggacgggttccctcaggggagccggccggagcccgagccttcccccttctccaggacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 156 - DNA, 2343 bp, Homo sapiens
agtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgacttaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctaccc

SEQ ID NO: 157 - DNA, 3091 bp, Homo sapiens
aaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaakggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatcaagttactatgaaaaaaaaaaaaaacccggggggggccccggaacccaatccc

SEQ ID NO: 158 - DNA, 1218 bp, Homo sapiens
  misc_feature (389)..(389): n equals a,t,g, or c
  misc_feature (740)..(740): n equals a,t,g, or c
  misc_feature (1048)..(1048): n equals a,t,g, or c
gaaaatagaataaatgcccatccataagactaaaatttcttgtgtttttctccttctgagtttaaaatggcactggatgacaaatggaaagcttgatgctgctcttaatgtgccgctaggattccggggatttcaaagccagtggacgggaggtggcctctgccagtgtctgtctggtgtctgtctgtgtcactgtggtgctgcctgggccacagacctaggcaggaccctgggtgatggagctcctgtctggtgggtgtgtgtgggcagtgctgttcctgtccacgttagaaaagccctcttactttacactgagtcatgctccctctccaccacggaccgcagtccccttccctagtgactcgctgtccccttcctttgttgcgcantttctggctttaaatgaggagagcttaagaatggatggggagctcagcactcacagtaactgttggtgaactcagggcctgctacgtctggaacacatcaagccatttagtgggtgaggtcattcactgtttttaaatgctgctgcagctcttatttctcatgaagccctttatacctattaaatacttcatagtattgawtaacttagctgsytgctcctctctgtcatggcaccttttgctcatgtggactttawggtgcagaaacacgaatcgattgtcgtaatgaacaamamccctctgaagtggccacggcgggtatgattcgtcccagttcacgggcgagtaacngaggtgcgcagtggcggggcagctggcccaggtcgtgcagctgctgtgcgtgagccagctcgctcctgagtttccttttgtttgacagcattttgtttacagacaccacaccaatccttggtcttggatacatcagaaaagttggagttctagaggtgggtggaggcaggacttgtaccctctccctgcagcaaagacaaattcattaagcatttggaacacttgttaagttcagtttgtctctctctaaaagttatcactagatgactctctcatttttgtgtgtgcgtgttttagatttgcctgtnacttacgaccagggatactggctttctatttatggtagtaatagcagttctccttttaaataaacttattttcagccaaaagagtgattaggtctatcaaaaaatgataaggaaataaacagtacagatcgtctatatttatggcaaaaaaaaaaaaaaagggcggccgc

SEQ ID NO: 159 - DNA, 1396 bp, Homo sapiens
  misc_feature (668)..(668): n equals a,t,g, or c
  misc_feature (739)..(739): n equals a,t,g, or c
  misc_feature (751)..(751): n equals a,t,g, or c
gctggtaaccaggtggaaccatttcacgtgtccctccccagctgcctcagtccccttccccacctgggccacagcatgggggttccctcacccaccgcctggccctctcttgcctcgttccacactcagaaaaaagcaaggatcagacaagaagaagagtccccacccctcccgtccccgcaggagctggcgttctctgcgctaagggtgttttttagagtgatgttttttctcctctgtctcgttgccctggagatcaaagggttcactttctcagcgaggggtgccagggacagatttctaaacaagtctggaccgcagccaggaaaaaagatgaaaacaacacactgtaaacagcctctattcagcaaacctggtcaggtcagaggggctytgaggaaagcaagagggaggcaggaggagagggaagcggtggggatgtggggggggcgggggcacagttatcctgaatacataaaaacaagtgaggtcactgaggtcagggatagtcccaaacatccccaagtccagcctttcctgacaaccagggttacatgcagagtcccaggccatctgcaggttttggaggccctgtgcggggcctgggggtctatgtttaaacacgcccttgtggtggtccaagtycccagaascaggggaagggcgantctgggctctgaatggcargtggggcagctccamctcatcctcctacatggcacccagcactgggctgcangcytggtccccnacttgccgcaggaatcaatcctgccagctcagagccsccgtgtgacaaacaccccaggaacagaggagacatgagaaagggactcaccagcccactgcccaggatgtagaagtcgtcgcaggagaagatggtgccggggtaggaggagaagaccagcttgttgccgggaaccagcgggtagtcccctgtgcaggcagagcgagccagggatgctggtcagacaggcacaggtggaggcccctgcaccctacctaacaagacacaggcacaggggcacaggcaggcctycgaggaagcccccactgtgtcctttttgtcatttagcaaatgaggtcattgggcatataaaagtgcatatacgtgcaagtaaaaataaaagctagcagcaaaacttatatagttggscctycatgtccgtgggttccacatccttggattcaatsgamtggggaccaaaaatactaggaaaaaaacatgattaaaaagaaacaacacagctgggtgcagtggytsacacctgtaatccctgcactttgggaggccaaggcaggcggatcacgaggtcaggagaccaagaccatcctggctaacacggtgaaacccgtctctactaaaaatacaaaaaaaaaaaaaaagggcggccgc

SEQ ID NO: 160 - DNA, 1564 bp, Homo sapiens
gcggacggtgggctgtgcaaccttcctccctttcttaaatgcttggggcatttgtctggccttcccttttactgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaagatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaaaaaaaaaaaaaaaaaaaaaaaaaaaaaagggcggccccg

SEQ ID NO: 161 - DNA, 1734 bp, Homo sapiens
  misc_feature (1417)..(1417): n equals a,t,g, or c
  misc_feature (1703)..(1703): n equals a,t,g, or c
  misc_feature (1714)..(1715): n equals a,t,g, or c
  misc_feature (1731)..(1732): n equals a,t,g, or c
gaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttngcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagaaaaaaaaaaaaaaaaaaaaaaaagggcggccgctctagaggatccctcgagggcccaagcttacgcgtgcatgcgagtcatantctctcctggnntgatcgtatgaagctnngc

SEQ ID NO: 162 - DNA, 2916 bp, Homo sapiens
ccacgcgtccgctagcccgggcggagccacagtcctagaggctgagcgcagtcggagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaaaaaaaaaaaaaaaaaaaaaaaaaaaaaaaaaa

SEQ ID NO: 163 - DNA, 1748 bp, Homo sapiens
agacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctaccctcctcagaacttgactgtgactgtcttccaaggagaaggcacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggcaaaatgaggcctgtatcaggagtgttgctgggggcggtcgggggagctggagccacagccctggtcttcctctccttctgtgtcatcttcattgtagtgaggtcctgcaggaagaaatcggcaaggccagcagcggacgtgggagacataggcatgaaggatgcaaacaccatcaggggctcagcctctcagggtaacctgactgagtcctgggcagatgataacccccgacaccatggcctggctgcccactcctcaggggaggaaagagagatccagtatgcacccctcagctttcataagggggagcctcaggacctatcaggtcaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtgaaaaaaaaaaaaaaaaaaaaaaaa

SEQ ID NO: 164 - DNA, 3116 bp, Homo sapiens
ggtgataatgaaagtggtggtggtgatggtggtaatactggtggtggtgacattggtggtggtggtgatggtggtgatactggtgatggtggtgatggtggtggcgctggtgaccctgacatggggtccagtagcagtgacagtggatgcaggctcctggtgactgaggagcatctcaggctgrggaggcacctctgatccccgccactgctccttaccccctacagtctctcagcaaacctgctgggcgacagcggactcagatgccttctggaatgtctgccgcagtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgycgggcagctgatggagacatgtgccaggctgcrgcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccaaaaaaaaaaaaaaaaaaaaaaaaaaaaaaaaaaaaaaactcgag

SEQ ID NO: 165 - DNA, 2679 bp, Homo sapiens
ccacgcgtccgcctcagcggccgggcccacggccccgagcagccatgctgggcgcgcgggcctggttgggccgcgtccttctgctgccccgcgccggtgcaggcctcgccgcaagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaaaaaaaaaaaaaaaaaaaaaaaaaaaagggcggccgc

SEQ ID NO: 166 - DNA, 1277 bp, Homo sapiens
  misc_feature (1207)..(1207): n equals a,t,g, or c
  misc_feature (1272)..(1272): n equals a,t,g, or c
cgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcarggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataangggcatgagcccttcctcaaaaaaaaaaaaaaaaaaaaaaaaaaaaaaaaaaaaaaaaaaaaaanaaaaa

SEQ ID NO: 167 - DNA, 766 bp, Homo sapiens
  misc_feature (670)..(670): n equals a,t,g, or c
  misc_feature (713)..(713): n equals a,t,g, or c
  misc_feature (721)..(721): n equals a,t,g, or c
  misc_feature (728)..(728): n equals a,t,g, or c
  misc_feature (731)..(731): n equals a,t,g, or c
  misc_feature (756)..(756): n equals a,t,g, or c
ggcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggaagcactgggtgmatnaagcctgttmccgtgttggaccgggggggttttaactggtggncggggaantcttttnggnttgcaagaggccaattaaagttggnccttggaaaa

SEQ ID NO: 168 - DNA, 1266 bp, Homo sapiens
tcgacccacgcgtccgttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacaggctgacttctgcctgggcaccgccctgcactcttggggactgtggttcacggaggaaggttcaccgtccaccatgctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtcctccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggc

SEQ ID NO: 169 - DNA, 961 bp, Homo sapiens
tcgacccacgcgtccggtattttctaaaacaataaatttatagtgttaatattcatagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaaaaaaaaaaaaaaaa

SEQ ID NO: 170 - DNA, 2181 bp, Homo sapiens
  misc_feature (5)..(5): n equals a,t,g, or c
gtacnggattcccgggtcgacccacgcrtccggcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggtcctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgcggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacmccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggacggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctggggkctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagwtagaytgytggtttgccaggaacatgccgccaaactgattgacggggagtacaggattacctggcat

SEQ ID NO: 171 - DNA, 2207 bp, Homo sapiens
ccacgcgtccggaaaaagggaaaagatgccgtgtaaaatctcgttctgtgtctgaattgccgtagggctcagatcttcatttgaggttctgtgtctgaattgccgtagggctcagatcttcatttgaggttatgttctataagttaacgttgatcttgtgtgagctttcggtagctggagtaacacaggcggcctcacagcgacctctccagcgccttccaaggcacatctgcagccagcgtagctcctcctgggagatgcctcctcaaggccctgctccagaccacgtggggagggcctgacagccaattcccaggctgtccccacccttggagagtgaccctaaacgctagacagatggggaatgggaaagaaaagaaagctgcagacctcaagttaaaattccctcaaaaacgtttttatttatctgctttttctgaaaggataaaggctttttgaaaattattttctaacaaataacatgaacacttctagaaaccctagaaaaacacaaagtattcaaaatagaaagaaaaattacccattactctttaagccagcattatccattgcggtgcttttggagttgggtgaggccgtagcctctgccaagtcaaggagcccggtggtggctgtggcattcctgcagggttgtttttttttctttgagatggagtctcactcttgtcaccccagctggaatgtggtggtgtaaacagctcactgcagccttgaccctgaggctcaagcgatccttctgccttggcctcctgagtagctgggatcccaggcgagagtcaccacaccctgtccatgttcctgcaggtcttgatatgcgaggacgctgtgtcttccctgccacattttcttcttctttcttgagacagacccttgctccatcacccaggccagagtgtggtggtgcgaacacggctcactgcagcctcgaccctcaggctcaagcgatcctcacgcctcggacccccaaagtgctgggatcacaggcgagagtcaccatgctggcctgaatcttcagggtattttacggttgaagtgtcacttacttaaccatccctgtttcaagagtgtaggtggtcaccctgtctctgccgctgacctggcctggaccctcggctgtgagagggaggggtgggctgggctggaggaacctgaagccctcgtgatgtcacaagcccatctggctgggcatcccctgctgtgtcctgagctgcacatgccccaggtggcccccacagcagaggcgagccactggagggtggagggcttccacgggacggtcttcagggggagaaggaagggcccaggcccccaggagactcaggagaccagagcctggggtcaggggctcagccaggggctcagccagggctggatgtccggagccagccccgcagccctgtgttctttgttcttcgcactcccaccgtccgtgtgaacagctccagccccacctgcgcctccctgtgctgggctccatcagggagcccagaagacgtgtgtgcttctgaaattgggtccctacatgcctttgtcccagtgcaccttgctccttccatttactatcgagatttaaatgcctgttttctccccagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttttagccaataggaattttaaaataacatggaacttacacaaaaggcttttcatgtgccttacttttttaaaaaggagtttattgtattcattggaatatgtgacgtaagcaataaagggaatgttagacgtgtaaaaaaaaaaaaaaagggcggccgctctagaggatcc

SEQ ID NO: 172 - DNA, 2070 bp, Homo sapiens
ttttggtttttttttttttttttttttttccatctttgaagtcctttattcccagcagttcacatcagttactcattgagctggggttcgtcatattaaccaagaattcattcatctttcttttgatattgtaatcttgtcctcatctccacaactgagttggggcctgaggggtttaagagttctcactccatcacaggaggcaaggggtacccttgtgaaccagacttcaactcctggaagtcttgttcagttcataggcaaatatctttgcaagtttagtatgagacagcccaacggttaaataaataagacacagtgccatggttctaggcatttggagagggaaaaggcacattacacagattcccctggagaaaatacaggccattctcatcttctcaacatgcattttcccactcttcagtgacttttaatcttatcccctggtctatgagaaaccataacccacgtgctactgaatacatttttattttcccttcatgacatagacttggttccaagtatattttattttcctcccttatgcctacaagacatccaattttgttcaggtcccttttaatggcacttaataaatatacattctgagacctggcagaacaggctgtcccctttcacactgcctttaaagcgcctgtttgaactagctagtgcagagctcaggtggggcacgtcctagcttacagctcwtggccatctctggcaccaggtctatctgtccaatactttgtgtctagggtagaggtccctaaccctggctgcacattggaagcacctgggaagctttctgaattcctgaggcccgagccacaccctaaaccaatttcatcagaatctctgggtgggacggagcctggattctgccagttgaaacctgccatggtaacttcagtgagcagctacactgagaactcctgagctacaattctagcacacagtaggccttcggtaggtatctgtggaacccacgagtgggtttcctatttcattatctgttcccctatgctctctatttttatcagaaatctgagcaggaaagagcagagagaatgagtcaagagcatcctctcaagtgaattcgctgctgagaaaggaaccgtagggcttgcatttctcttgtgtcatgcagtcttcatgctttaacaggcccagaggaggcaagttatagactgacacagacatgtatatatttcttaaaagcccttcaaaaaccagagctcactgcttaggcactatggttataacacagacatgttcttggaagcatatctaaactacctcctgtttgacacacattctaacttgggttggttacaaactttgtcagttgttaagatcacacttggtcacattttcccatttctgtgaatcttgcaacttatctttgcccagagcaacagcctagacatgaccaccccaagcagggactgcactgcacccaacattgccccagcaggtcagtcctccttgaacaggaactgtttttgaggggctccaatttccaggttctagaatggggtggctcacttaccaagttaaagaggctggctacatagaatgcagtattgagaagccccccaaggtagatcctgggttacaggaaagaaagctatactgatgaacaaggtttgctgccacaggcatgggcgtgggggagggcagcatgccgggggccaccccgagatcactgctgtcatttacatttgtatcacacttcacagtttacagggagctctgcatgcttagccccatgtcattctcagcacaaccctgtgagtgaggtctttctggatgggaacactgaagttgtgtcctacatctaaggtcccacagccaattgcatcacatccacggctgcctccaggacctcaggggccacctgaaaccactgggggttccccctggctccccttctaaccagaaacaggaaagcaagccattccctaacctccccacccaccaggccttatcaccgccttcccagagtttcctctatgatttgcatacccctttgttccctagtcctgagaacacagcagagctttc

SEQ ID NO: 173 - DNA, 566 bp, Homo sapiens
  misc_feature (68)..(68): n equals a,t,g, or c
ggctatttaggtgccctatagggaaagctggtacgcctgcaggtmccggtccggaattcccgggtcgncccacgcgtccggtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaaaaaaaaaaaaaaaaagggsggccgc

SEQ ID NO: 174 - DNA, 1242 bp, Homo sapiens
gcgtccgcacctcaggccctccaagcgcaggatgcaggccgtggccaacgtgtccattggggccatgttctgcatgtatgggctcacagcaacctttggatacctcaccttctacagtgagtggggctggggctagggctggggggagggggaaggcctggggcaggagcctctgagctctttccttctgtgaccacggacctgtcaagtttccaaacagaaaggtgtgcctcacttgtgtggattttgtcacttgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacaagcagaggcttgcagactggcccacttccctcctccccaagggatgccaagcttggatcatggccctaatcccaaccccaaccccatgggaggaggaggaggaggaagaagaggaggaggaggaggaggaggaggcggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaaaaaaaaaaaaaaaaaaaaaaaaaaaaaaaaaaa

SEQ ID NO: 175 - DNA, 712 bp, Homo sapiens
  misc_feature (26)..(26): n equals a,t,g, or c
  misc_feature (28)..(28): n equals a,t,g, or c
  misc_feature (77)..(77): n equals a,t,g, or c
  misc_feature (117)..(117): n equals a,t,g, or c
  misc_feature (124)..(124): n equals a,t,g, or c
  misc_feature (696)..(696): n equals a,t,g, or c
taggcccgggacggttacaatttacncnggaaccgctttgcccataggctttgcaaaaagctttttaggtgccactntagaaggtacccctgaaggtaccggtccggaattcccggntggaccnacgcgtccgaggaggtcytttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgctaaaaaaaaaaaaaaaaaaaaaaaaaanaaaaaagggcggccgc

SEQ ID NO: 176 - DNA, 1200 bp, Homo sapiens
ccacgcgtccggaattttgttgttctctgtctctttgatttcctggaagacgacaccatgacaatttcaaagaaaatagaacaaaatgaaggaaaaagaggctctgtcttagcacattcctgtgaccagcctgctgtctgtggtgtgccctcctggcccggccttggcacatgttcgtttttgtggttgttgcctggacaggcaactctgcagggctgcttctctacgcatccctttgcctgcctgcctgtgccaggggttgtcaagggcttttgggtcagagtgggcacccctttctccaaggctccctgcaaagctggcctgtccctggtggggctgacagcttccttctcaccctgccaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 177 - DNA, 1352 bp, Homo sapiens
ccacgcgtccgacagcagagatctgtggagtaggattgtgggctggcagtgggtttatcccacagacctaagacagctacttaatttgtatagacccttcccagcctgggcctctgggttttccttctgggtggagatcatcttctgtaggaaatggaactgcttcaagccaagaagcttttacttttactaggtctttttgtgtcctgctgttcaaatattaggaagactgaaccctgtttcggtcttgacagtattacgtttcgtgatcccaaaaaaaagtgtttgtgtaacctcaagtcatgctgaaagtgaaatacagcttaaagtgggattctgctggacctgactcaacttttcacctcaccgcttggctccgtgcaggcagtatttgagtatgtggttccccctcaagtctgtaggagttgtattgtcaataaagtccaaggccagagtgcttgctttctagtaagtagagagaatttttgaaattcaacgacaaacatttattaagcccttattgtgtacagggctcaaagctaagtgctttgggtgattcagggtgattagggataggattccatcttcaagaagcctcccatctaggaagaaaggtcgataagcatagttttggacacatgggagagcatggctttctctgggcccagtaattactttggtatccagatcattagagaacggaatgccttctattgaactatgtaacagtcacaggtttagatcttctcaagttattattgcctttaatcttcatatgattcctatcctgcagttaggaaatggaaaccctaggatatagtgactgtgagctcagaaaattaggttgggagataagccagtagattgaggtggtagattcttcaagatcttgaaggggggaaggtggggggggggacgggggagctgtccccagctatatttgcccttggcagatgggatggattctgggagaaagctctaagaaattaggcctgtacgacttattttcatgaatctagctgctaagctggaataagtgaagttaaaagtagtgatgggccaggcacggtggctcacacctgtaatcccagttctttggaaggctgaggcaggcggatcatgaggtcaggagttccagaccagcctggtcagcatggtgaaaccccgtctctactaaaaatataaaaattagccaggcatagtggcacgtgcctgtaatcccagctactcaggaggctgaggcaggagaatcccttgaacctgggtggcaggggttgcagtgagctgagatcgtgccactgcactccagcctgggtgacagaatgagactccgtcttaaaaaaaaaaaaaaa

SEQ ID NO: 178 - DNA, 3533 bp, Homo sapiens
  misc_feature (44)..(44): n equals a,t,g, or c
ttttatttacttcaaattaactgtactttactcaaatagaaaangaataattttcacattatgaagctacacaattccaaaatacacatgctgaggctctttttaagtccgaattgtctagtaattacaaaaaagtgaagagtttacagatatacaaggaaataaaggcgaattattgcaaagaaaacaagtttaatttcactttgaatgacaacgatttttctggaaagcagatacttcactcctttaagtttccacccaagccacaataatttcaaacggtcttgcggatgacccagctggtcactcttgtttatgtggggactggaggtaatgagagccaaaaaaagtgctataaacctaatttggctagagcaagttcacacgacacgaccgtgctttaaaaacttgctctccattatgtacttccttccatcaggttggggaaaaaaaaatggtggggatggtgagtaaacacaccagtggtttcatcagaggggaactcactactcaggaggtgacggtgacgtggtgccggtccctgaagtacgcgcacaagctccggaggttgcgggagcttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctargaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctcaaaaaaaaaaaaaaaaaactcgag

SEQ ID NO: 179 - DNA, 639 bp, Homo sapiens
ggcacgagcattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtatgccaaaaacttgattatccttatgaaaatttcaattctgaataaagaataatcacattatcaaagccccaaaaaaaaaaaaaaaaaaaaaaaaaaaaaaaaaaaaaaaaaaaaaaaaaaaaaaaaaaaaaaaaaaaaaaaaaaaaa

SEQ ID NO: 180 - DNA, 1434 bp, Homo sapiens
cattaaactctttttatcgggaatagtatgatattttcaatgtcactccattcatgttgatttggagctgacagttattttgtgtaagcagagatttaattttatattgaaagtcagtgcaaaattatgaataggatatactaataaatacaaagtaataacaaaagtcaaagcagtgttctaaataaaaattctgggttccttaaaaattattttaaatttatcttgaaatagttttcttagattaatctcaggatatgagaaagtcaattaagtgtgagtaaagttagtatcattaaacaaattgtctattaaatgcamgagtggtaatatacagaatttatcaggcattaccaagtctaggcacatataggaaatgcagcactcagaatggtttcaatgtagtagttgatgcttgtaaggtaggggagcttattcagacatagtagatagtttctctaatgctgtstcaattgctggcctttggctacctgtacttccscattatggcagcccattcagtcttgagttttcttctctggacaccttatgctctgaaatcatgagcgaggctgattcaattggtgatttgggtagaaagcagtatgttttgctgacattaagatgtaggttatagataggtttagcctttaagtgtatgtttttatactttaaaataagaaatataaccttttaagctattccacctcctcccccagcctatctcaaactggtggaatatatggagagatcttgaaagaagtaaaataaaccttcactgctccactccaggtgaatccgcccactcccactgacctagtagaatttgtaatttaatacttaccttctatttctgaaatcagttgtgaactgttgccttatgttcagargtttaagaacctcmgtgaattcattttttaaaatctgctattctgagaagcattgaatgaattcttaacaagaagactcatctgtagctgtttgctgactcctatgagccccataagggttctgtgcttagcattaacaaaataaggtttataggtaaagccaatgtattaatttttttttgcatggagggctttaaaatttgtgctctttttcatattttattcatattcaatttatggtttgtaactgctttttagggagataattatatgttataaattagttttggggggaataattgtgcaaagaggataatttaatttacgtgcttctgttattcagaataaagagagaagactacgctgcatattcaagagttgtaccttaacattggtgaaacattttttctaagattttcaaaaggaatatgtgtaaattgagaaatcataaccactgtcctaacttggtaaacaaactgttcttaaataaagtatttaatgattttaaaaaaaaaaaaaaaaaaaaaaaaaaaaaaaaaaaaaa

SEQ ID NO: 181 - DNA, 2067 bp, Homo sapiens
aattcggcacgagcttttaataggaagtaatgtctcacccaagagaaatgaagagcagggaagagtgactttctccttctccctccctctcccctggatatggaactcaaccattatgcactgcttctttttgtggttgctgctttttggacttcttggaattagtggtttccttggttatatttcagtggctggtarcagtatatatgtcatgtggaaggtggaraaggaaatgaatacttaggtctcaaagacccactctccatggctgctttagcagatggctgtttctttctctcccttgcaggttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttgggaggatatgggcagccctcatgggagacttacccatttatgttaaaacagtgttttgcaaaggggagcagcctctggaagacggacgtcttgaaaaggggggcgattccagatcattgctgtcaatgggcagagtctagawggagtcacccatgaagaagctkttgccatccttaaacggacaaaagggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaaraaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccakgttgactatggkttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaat

SEQ ID NO: 182 - DNA, 867 bp, Homo sapiens
ggcacgagcaggtactgggtgactgcctggctgaggaaaagttaactagacacttggggaaaggagatccaagggagtaagaggcaaaatgcctttgcatgcttttcttcctatctctttttctttctctccttctcactctctcccttccttcctttcttcctttctctttcttttttttttctcttttcccccacctctctgcctgcctccttccttccctcccctcccctcccttccccctccctccctccctcccttccttccttccttccttccttccttccttccttccctccctcctctctccctccttccctgccttctttccttcgttctgccaacttgccagaaggagcccaagaaaaagcacccagatgcttcagtcaacttcttagaattcttcttttttttatgttcagaaaagatggaaattcatttctgctaaagagaaagaaaaaattggaagacagggtgaaggtgaacaggcccattataagaaagaaacaaaaatctatattctgtctacaaggaagcgagagagagaaagagagagaagaaagaagttccaggattctaatgtaccaaagggatctcctttttcttgttttgttctgaaaatttcaccaaaagagcacaggagaacatcttggctaattcattggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgtcagggaaaggggaagttggaaaaactggaaaaagaaaaaagaaaaaaaaaaaaaaaaaa

SEQ ID NO: 183 - DNA, 1422 bp, Homo sapiens
gtctccgctcctgtgcccgggaagatggtgctaggtggttgcccgaatcacgccattttttaacatctctttttgatcaaacaagaaaaagcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggaaaaaaaaaaaaaaaaaaaaaaaaaaaaaaaaaaaaactcgag

SEQ ID NO: 184 - DNA, 1558 bp, Homo sapiens
ggttttggagtatatatattgtatgccatgaactatatttttctgcttatggctttgcctcatttaattgccatagcacttacatggggcaggtattcattttcctgcttagcaaataaggaaactgaatttcagagatgtcaggtaacctgcctacttcacacactaggagttttgatgtttaattttgaactaagatctatctggcttgaaagctctttgcattaaacaaccttgaacaatatacttggaacgtaggtgtgtttttggcacagaacatggcatgtgtgtgagggattgaacacagacttgcccagattcaaacttaccaatcttctgtttcatgtgcccagaagaaacagcctgtttctcagcctcaaacccaaacttctagttgtcttgattggttcagcctgactgtccaactctgatttatagctgtgattgggggagctgagattacacagtgtaggcaggcagaagggccccaggcctattgatatgggtgaggacaatactcacgcactcccttcacttactcactcttccaaggtcttggcttgaacccaattttttttgagagaataaaccaggctttttgttctccacttggcctgactccatttctggcattccagccatgtatttagctgttatcagctttcagatttagascaaagccttgtttccaataagcttgtttctctgaagtaattgttaaaatataattttcagaaaaaggttaaatcatgactcatacaaatataaaaatgaacatgtgctaaagatttttatttcactcatgtgatatgaagtaaccagacagaagttataaccagtacatatggaaagtcaaaaagcacaaattcatatgtagtaaaggaattggattgcaaatgaaggcaaaactgtttttyctacagggtggagggaagataatcaaaatgctagaaccagaatttscatgcctgtcacttagcttcaatttacaaaagcccagaataactcaaaggcaaattctagccctgcaaatatcagccctaaagctgtgctgtggccagtgcatagttttctattgaagtacaattttttccccaaatacattatctctcagagggagtccaaattgcttccctttcactcagcagatctgttcagtcaacagatgttaaatagctacagcgtatcaggcacaaataattctttataaaataaagtaacaaactatatgttgtttcaaagttccagttaaggccagccgtggtagctcacccttataatcccaacactgggaggccgaggcaggcggatcacttgggctaggagttccataccagcatggccaacatggtgaaaccctgctctactagaatgcaaagattagccaggtgtggtggcgcatgccggtagtccaggctactcaggtggctgaggcacaggaatggcttgagcctgggaggcggaggttgcagtgagccgagattgcgwccgctgcactccagcctgggcaacactgtgagactcctgtctacaaaaaaaaaaaaaaaaaaaactcgta

SEQ ID NO: 185 - DNA, 1288 bp, Homo sapiens
cccccgggctgcaggaattcggcacgagcctgacctccccagcctcatctctccctcctctgctctcgccctctgtgctccagccaacgtggcctgtcactcgtccacctgccatactgtcctgactccaggcctttgcctgtgctatggcctctgttgggaccactcttgtctctcccctgctgtgtctgctaattcccactcgtgtcagtgatccatggctgcagaacacaccactccatccatggaaaacaatcacaatcattgattactatctctccctgggcttcctggggtggactgggctcagctgggtggttcactttggggcctcagcagtcatgggcagacagtggctggggtcactgcaaagacttccctgcatctctggcagttgatgctggctgtcatctgagacacctacccagggcctctccctggggcctgggctcctgcttagcttggttgggaggctccaagaccaacatcccaagaaagatgagacagaagccagatcacctttttgggcctggcttcagaagtcacccagcatcacttctgctgcatttatttcttaaaacacaaatatcaaaccccatctcttgatgggagggggcctcatggtttgtaaacatgttctaaactccactctgcccggccttggctcaacgtgtctggtaatgtgtgggctgtgaggctccccgaacgtagacctcagactgcaacgctggccgttacagggtctggcacacgggcccacgtcaggcccatcgccacagtgatggttgttctgtgactgtttctggtggcctctgctccacactccaggctgacgctgtgccccttccactgggaccctcgggtggcttccatgcacttgtgccctaaatcctgctcctagactaaacttcatctcctgtgttctcattctgcagcatggctgttagggaacctgaccatctgcagcgcgtctcgttgccaaggtataatgtcagtgcctcccttcagtggctcccatgtcacagaattgtcctgcagccctggcacatgtgtgccatgtgggagctggggcaggtcctctttcatcctgtggctccgagggagggggccgctccttccccagtctctaccctgacttggccctcgtcctgcagccactcagagagcacgatggagctggagcttcagttttgaccaaatgcgtgtcgccggcttttgtgtgtgtgtgtgtgtgacagagccagaccctgtctttaaaaaaaaaaaaaaaaaactcgagggggggccc

SEQ ID NO: 186 - DNA, 1152 bp, Homo sapiens
  misc_feature (668)..(668): n equals a,t,g, or c
  misc_feature (745)..(745): n equals a,t,g, or c
  misc_feature (1015)..(1015): n equals a,t,g, or c
  misc_feature (1088)..(1088): n equals a,t,g, or c
  misc_feature (1110)..(1110): n equals a,t,g, or c
  misc_feature (1113)..(1113): n equals a,t,g, or c
ctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttkagcagagagtggcgtatcctggcagtcttcggtgagccagttgtaccaggattatgaaatgcagatgtttactgtgtcattgttgctgtcattgctactgaggagtactgaccagaatcatctgcaactyttagttggcagagaggaccactatggcgggtagctcttttctttcctgccattgtggggatgattccaggccaaagatgatggaraagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccaccraaaaaaccccmaccaaacctaagaccttactgcaactaagtytnccaagtactttttaacccaatgggatgaacagcctgtggtctgctcagatcaccctgagtgcgtgtgagaaggcmtnggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcangttgtagtaaaaaaaaaagtctacatttttccaccgccacgttcttatatcctgtttgtcagccactgctcanaagggcatgttgtcttgcggantanaggcgctctccttccctcgttttccctataggttgggtg

SEQ ID NO: 187 - DNA, 2199 bp, Homo sapiens
ggcacgagcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactggggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctcatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatcccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgaaaaaaaaaaaaaaaaaaaaa

SEQ ID NO: 188 - DNA, 1761 bp, Homo sapiens
  misc_feature (1207)..(1207): n equals a,t,g, or c
gctcgtgcattcatacaggagatgttatgattttscctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgcttagaacaatgaaaaattatttgttgtatctaatacacgcctgtattgtgaaaagcttcatttagcaatgatgtaataatttttaacttccaggnaaataatctgtgaatggaaagattttttaagattttgagatagtgtttagtctcatgttgggaacacatgaatgtgatgaacatagtgaatactaaagaaaacgcttcagactttcagatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaaaaaaaaaaaaaaaaaaaaaaaaaaaaaaaaaaaactcgtag

SEQ ID NO: 189 - DNA, 1999 bp, Homo sapiens
  misc_feature (532)..(532): n equals a,t,g, or c
  misc_feature (1490)..(1490): n equals a,t,g, or c
gcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagtaagggatgcacatgcagtggccagtgtgccaggggtatggttggtgtctgggaagagcctagctggttgttgcctttcctcggtacctaggtcttcaacatcttggtccctctctaggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggancagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggtaggcgagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccncagaggcatactgccagcagcgagtgttccgctcactggcctacatgcggccactgagcatatgggccatgcagctagccctgcaacagcagcagcacaaaaaggcctcctggycaaaagtcaaacagggcacaggactaaggacagggcctatgtttggaccaaaggaagccatggcaaacctgagcccagagtgagccgtctgaactgtggragggaagtgctaacagcccagcctccagcctggcctttcctccttccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagccaaaaaaaaaaa

SEQ ID NO: 190 - DNA, 1636 bp, Homo sapiens
  misc_feature (424)..(424): n equals a,t,g, or c
  misc_feature (823)..(823): n equals a,t,g, or c
  misc_feature (960)..(960): n equals a,t,g, or c
gaattcggcacgagttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagargaagaaaaggaactgagaagaactacmtataaactacaagtcaaaaatgaagaggtaaagaatatgtcacttgaactcaactcaaaacttgaaagcctcctagnagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagacyttctccagaccgtggaagaccaatatwaacaattaaaccaacagcatagtcaaataaaagaratagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgcatncagacccagcaactctcaagtttttcatgtctactgtgatgttatatcaggtagtccatggacattaattcaacatcgaatagatggatcacaaaacttcaatgaaacgtgggagaactacaaatatggttttgggnaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaaaaaaaaaaaaaaaaaactcgaggggggcccggtacccaattcgccgg

SEQ ID NO: 191 - DNA, 1077 bp, Homo sapiens
ggcacgagttggtgggcaatagcgcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgccaaaatgacttaaaccattcatatcatgtttcctttgcgttcagccaatttcaattaaaatgaactaaattaaaaaaaaaaaaaaaaaaaaa

SEQ ID NO: 192 - DNA, 1392 bp, Homo sapiens
attcggcagagcagaaaaccagactgcacttgctttataaaacagagctttatttttccttcataataagcagagttgcagtgttgctggtattgattcactggcgtggtggtatcaggacagatgtctctatgattaatttttggcctgtcactcatgtttgcatatggctgttgtggctccaagcattggaagcaagaggacagggaagcaacattgactgtaccaggaactccaaaacagtcttcacatcttaatggttggacaatgccaaatggtcactcttttctggaagttgactggggacaagatagtggtaaggattagatttggccagaaagtttctgccacagtgagctttcctgtctaaatccttattttaactgttgtcacttaatattcacactttggaaggacatctactgttggttacaattatgaaaccaacttgaatactttttagttgaacatttcagtagtcttaattatgtttaaataggtttcacaatttactgtttttagtttagtttccggctccccccaacccccaacttttgytagagagttactctcttaacttttgctagaaagtagcaaagttctctactctacatgttcagggctggctgtagaatttcgttttttaaggaaacaggaagacagaactaattatgcaagtcttcatttagctttttaaaaaaacagctttattgagttagaattgacatgcagtaaatggtacatatttaaagcgtacaatttgttaagttttgacataagtatacattgtgaaaacatcagtcaccacaatcaggatacttattttaaaaaacaactttatttaggattagtatactgataatgtgtccattgtaagtgtacattttcagttttgacaaatgtatagatttttgtaactaccaccaccagtcaagatgaaaacgtttctagcactccagaaagttcccttgtgtcccttcttggtcagttattcccaccatgctctcaggcaaccacagttctgcttctatcactatataagtgacagaatttttctacagaatttcacatagatggaatcatacaatatgtactgttctgtctggcttcttgaggtaagccaaatgtcttttaagagtcatgcatgtttttgcatttattagtagtttattctttttttgttggtgagtagcattcattgtatggatatattccagtctgttttattcattcactttttggacatttgggttgttatcaattttgggctcttttgaattaatccctccctccttccctccttcccyccctccctccttccctccctccctccctctctccctccctccttccttccctccctccctccctcccttttttttttcggcacga

SEQ ID NO: 193 - DNA, 717 bp, Homo sapiens
ggcacgagctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaacttaaaaaaaaaaaaaaaaaa

SEQ ID NO: 194 - DNA, 832 bp, Homo sapiens
  misc_feature (827)..(829): n equals a,t,g, or c
  misc_feature (831)..(831): n equals a,t,g, or c
gaattcggcacgagtatgaaactaacaacatagaatgccccccaaacaaattcctctaacctcactgagtttacttgccctattactattttttttttttaagatcttctgtctcttgtttttgttttatcccttacctgatgaaagtgaacatttctagtggagaaagaagatcacagttctctaatatgggcattaagagaggggtacagctagaggggaggtgaaaacctgcctccactggggtgaaaaacagtgtgctgaggtttcagccagtgattacactgggtaatcaaccagtcccatgtttcacaaaggagttgtaatgattaacagttcaggtatgcttytgaggaaatctaattgagacctttggaaaatagcattgttatgaatggtgtggtgttacgccctggaggggaaaaggctaggaaaaacattttaacttttcaagtgtatttaaattaacatccaaatgtttcagtgtgctttactggagactgcctgagtttggaattcaaatattgtaaccaaattactccaggtttctgaactaaaatgatctattgatgtttctcaaagtatagatcacagagtaagaaaagaggaaatcaagtctggtttatgacaaacttttttccatgttaacattggacccaaagatgttamtaagagctttttactactgtgagagraccagcgtgatgtgaagacaacgaacattttaagaagtttgactagtagacatttcgtttaagtcttttggagggtcttggttgacaacccacaattttattgtggctccccaggctgggagaacgtggaannncna

SEQ ID NO: 195 - DNA, 1209 bp, Homo sapiens
  misc_feature (1)..(1): n equals a,t,g, or c
  misc_feature (1097)..(1097): n equals a,t,g, or c
  misc_feature (1120)..(1120): n equals a,t,g, or c
  misc_feature (1127)..(1127): n equals a,t,g, or c
  misc_feature (1141)..(1141): n equals a,t,g, or c
  misc_feature (1161)..(1161): n equals a,t,g, or c
  misc_feature (1197)..(1197): n equals a,t,g, or c
nccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttcctttccttagtttgggaaacgtngaattctgttttttggtggttancttagtnctctgtggtttttnagtttgggaaattccaattnatggctcaagaaatacttgcttagcagaccaatagnccattataattt

SEQ ID NO: 196 - DNA, 2149 bp, Homo sapiens
acgaggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgatgccattaaattaatgaaagacatttcacagaacttccccataaaagccagagtccaaatgattggtaatgtcttaattggatgaatattgtgtggagtacttttttgccaagaggatgtctcgttgaactgcttccatgaatactgatgttacattaaacatatattccatttcaataggaaatacatttgcatagcttaaagagaccggtgcatgcaatgcaagttaccacgtattatgagaatttgctatataacacaactttgatgcaattgtattctggttagggatgacagagtataaaattagcaacaagtaaaatatgagttagcttatactaaagagataaaatatgtgacaagtcgcagtgcatgggcaacaatggtgttttactgagaggaattggagagcagtctactagcttagcataccttcctaagcatagaatgattgctatgcctcttattgtcccaaacactattttgtacatttattcatcatacagattacagaatcttcaatatatgtattctttaattttgaaagtaaataaatagtacatggttggctacaagataccaaggattttttggtggtaccttgaaataaaggagtttgttccttatttacagattaagaatgaatatattgatatgcctctttcagtcaactttaaatgtcaagaatttgagaagtcgtcatttatataataaaacatgaaatatatatgggtgtgtataaatgtcatatctgtttagccataatattttaattaatggccgttataaaaattattagatcaaatacaaataaagtaaaataactttagtcttgatcagacagttgattagctctattgatgctaagtcagtataactgttcagaggttctgatgcaaaactctgctgttaatctgtaattaagaaaaaattataaaatatgctaacattgcttaatggctaaattgtaggcttgagcatatctctaaaaccacttggtagacaatctgtaaatgtttgttgaaatgaaatatttgctaaataaatgaaaaatttgccttaaaaaaaaaaaaaaaaaaaaaaaaaaa

SEQ ID NO: 197 - DNA, 1084 bp, Homo sapiens
ggtttgggggcatcacagactacacccgtatgagaggatgaacttaaatgataaattgtgtgtgtgtgcatgcatgtgtgcgtgcatgtggactgttacactcattggtccttctgctgtctctctccctctcctcagccctctttattccctgggacacagaaatttttaaataaggccaattaataatcctacattggtctcttacgtgttagagtgaaaagaagattcacatatctctcattttaaattgaaagctagaaatgattaagcttagtgaggaagccatgttgaaagctgagatagtccaaaaactaggcctcttgcaccagttagccaagttgtgaatgcaaaagaaaagtgcctggaggatatttaaaatgctgctccagtgaacacacaaacgataggaaagcaaaatagccttattgctgatatggagaaagttttaatggtctggatagaagatcaaaccaactgcaacatttccttaagcaaaatcctaattcagaacacagccatagctgtctccaattctatgaagacagagcagagaggaagctgtggaagtaaagtttgaaaataagaggttgttcatgaggtataaggaaagaagacatctccataacataaaagtgtaagtgaaacatcaagtgcgaatacagaagctgcagcaagttatccagaaaatctaagatcattgaagaaggtggctacactaaacaatagattttcaatatagacaaaagagccttctgttgattttaggcatctagcctaaaatggaagaagatgccatctaggactttaatgggtagagaggagaagttgatacctgtcttcaaagtaaagactgactcttttgttaggggctgttgcagctggtgacattaagttgaagccaatgctcattcaccattccagaaatccttgtgcccttaagaattatgctaaatctactctgactgtgttctacaagtagaacaacaaagcctggatgacagcatatctgtttatagtcatggtttactaaatattttaagcccactgttgagacctactgctcagaaaaaaaaactcgtag

SEQ ID NO: 198 - DNA, 582 bp, Homo sapiens
  misc_feature (20)..(20): n equals a,t,g, or c
  misc_feature (27)..(27): n equals a,t,g, or c
  misc_feature (49)..(49): n equals a,t,g, or c
ccgtttgccggcccgcctcntgggacntggtggtccccccccgggcctncagggattcggcmcgrgtgcatacatgcctacctatgtatatataaacaaacatttttgtaaacagctcagtgaggactttggactggcataaatcataggaatatgattatgaggatacatccaattttcagattgggcaatgtatacagtttattatcatttctgattttgggtagagttagtactaagaacagcattgaagaaaagcagtataacattaaaattaagaagatttaaaatacaagaggattcataacagtcacttttaaaatattgttttggctttctactttggagctgtaattttaaaaaaagaatgaacaggtttttgtatgaatatgttagaatgactaattatagagcatctttcaactggaatacatgtagatactaacacctggttgtatttgatgtaatttcagtgcatacagtgtgtgtaatctgtattaagtgaaatacttatgaataaagttgtttctgcattgcaaaaaaaaaaaaaaaaaaaaaaaaaaaaaaaaaaaaaaaactcga

SEQ ID NO: 199 - DNA, 1046 bp, Homo sapiens
  misc_feature (483)..(483): n equals a,t,g, or c
agcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggncagaaggcctaaatccaaatttcttattttttataatttaccatagaagttttgtgattaaattcttacttctgccagtggaggtttatgcctgaaagtcatggggtcctgtctgtaaatagacctaaagagaagtgcagtatttattctttgtaggcataatgtgtttgtcactgacaagcattcatattcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaaaaaaaaaaaactcga

SEQ ID NO: 200 - DNA, 558 bp, Homo sapiens
ctgcaggaattcagcacgagytggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagggggggccggtacccaattcgscctatagtgagtcgtattacaattaatgggc

SEQ ID NO: 201 - DNA, 685 bp, Homo sapiens
  misc_feature (678)..(679): n equals a,t,g, or c
actacggctgcgagaagacgacagaaggggggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaaaaaaaaaaaaaaaaaaaaaaaaaaaaaaaaaaaaaannaaaaaa

SEQ ID NO: 202 - DNA, 1669 bp, Homo sapiens
  misc_feature (587)..(587): n equals a,t,g, or c
  misc_feature (1634)..(1634): n equals a,t,g, or c
  misc_feature (1648)..(1648): n equals a,t,g, or c
  misc_feature (1659)..(1659): n equals a,t,g, or c
  misc_feature (1668)..(1668): n equals a,t,g, or c
aggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggtcaggcgggctgagggtggggaggccctttgtacccagctcagccctcggcggcgctccctcctcccgagcccagccgggtcgctggctcccccagtacctagcctgagggtgccccgaggacgccaggccccctgcctagagctccgggccgcacgtcggagggggccgggcggagaggcggcccactagggccggtcgtgactatgtgtctgccccgcaggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtcngcactccaattctaccaggatggctctcttcgctggtggcaaactgcgkgtgcatctcgacatccaggttggggagcatgccaacaactaccctgagattgctgcaaaagataagctgacggagctacagctccgcgcccgccagttgcttgatcaggtggaacagattcagaaggagcaggattaccaaagggcaagtgcatatctccttgtaatttgagagggcagttgacctttatacccactatacctactcaagtttctgcttgggagatcagctctgcagagaatggaatgagaagtattggtttagataggttgtttgtttgttgtttttgagacggagtttcactcttgttgcccatgctggagtgcaatgccatgatcttggctcactgcaacctccgcctccccaggctgaggcaggagaatggcgtgagctcgggaggtggagcttgcagtgagctgagatcgtgccactgcactccagcctgggcgacagagtgagactccttctaaaaaacaaaaacaaaaccaaaacagtagttagggtacacacacacaaattctagtgattttccccccagtactacccttgacttttgaaattcctgctttctcagagtttacaacatccttaccaaacagccttctccctccttaccacaaaaaaaraaaaaaaagttctggggttgaggggacactccattcttaacatcctctattatcccagcccaattccccagctctcactgggactagttgtacctatcttcattcatttggtcccagcatgactacctgttggtgcatgagctgatctctcctaacctaacagccagatgctagtctctggtactyagatgctgggctgcatcagataggatgcacaggatcatcctgggaagcttgttgacatagattcctgtgcaacacttcagatatagtcttaatgtagatttgtgttggggtggtatggtaggtagaataatgggcctaccactgtgtaaacatatggatatgtttacctaacatgacagaagaganttaagttgctaatnagatgactgtnaaataaatna

SEQ ID NO: 203 - DNA, 1038 bp, Homo sapiens
  misc_feature (806)..(806): n equals a,t,g, or c
ggcacgagtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcrtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatartggctctcctatacgaagagcccttcaccgctgagatctaccggcagaaagcctccgggtcccacaagaggagctgattgagctgcaacagctttgctgaaggcctggccagcctcctngctgccccaagtggcaggccctgcgcagggcgagaatggtgcctgctgctcagggctgcccccggcgtgggctgccccagtgccttggaacctgctgccttggggaccctggacgtgccgacatatggccattgagctccaacccacacattcccattcaccaataaaggcaccctgaccccaaaaaaaaaaaaaaaaaaaaaaaaaaaaaaaaaatttgggggggggcccc

SEQ ID NO: 204 - DNA, 921 bp, Homo sapiens
  misc_feature (4)..(4): n equals a,t,g, or c
  misc_feature (9)..(9): n equals a,t,g, or c
  misc_feature (11)..(11): n equals a,t,g, or c
  misc_feature (15)..(15): n equals a,t,g, or c
  misc_feature (20)..(20): n equals a,t,g, or c
  misc_feature (901)..(901): n equals a,t,g, or c
gcgnggggnanaggnaagcnccccactattgggttcaaaagctggagctccaccgcggtggcggccgctctagaactagtggatcccccgggctgcaggaattcggcacgaggtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggtggagtccaagactgtattctcaatggagctactgctggggagaactaggtgtgggaaatttgaagacgacattgacaactgccatttccaagaaagcacagagctgaacaatactttcacctgcttcttcaccatcagcaccaggccctggatgactcagttcagcctcctgaacaagacctgcttggagggattccactgagtgaaacccactcacaggcttgtccatgtgctgctcccacattccgtggacatcagcactactctyctgaggactcttcagtggctgagcagctttggacttgtttgttatcctattttgcatgtgtttgagatctcagatcagtgttttagaaaatccacacatcttgagcctaatcatgtagtgtagatcattaaacatcagcattttaagaaaaaaaaaaaaaaaaaarctcgagggggggnccggtacccagggcggaaga

SEQ ID NO: 205 - DNA, 442 bp, Homo sapiens
ggcacgagatagaacccactgcctcctgatgaagtccctactgttcacccttgcagtttttatgctcctggcccaattggtctcaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttgaacattccagcctctgtctcctgctctaggatccccgactcattaaagcaaagaggcttaaaaaaaaaaaaaaaaaaaa

SEQ ID NO: 206 - DNA, 582 bp, Homo sapiens
ggcacgagatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccagtatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgaaaaaaaaaaaaaaaaaaaaaaaaa

SEQ ID NO: 207 - DNA, 809 bp, Homo sapiens
ggcacgagctcgaactctccactgtccccatttcctgcaacagcatctcagagggcttgaggtggctatcaggccttccatcacagcataaagctccttcagggagagaagagcgaaggcacccaggctggggaacagcagctcctactatacctaccctgcccactctggtccaaccgtgggcttggcctgactttagactggaaccccttagtgctcctgttcctggtgtggagcagatccacctaccccaggggaaatgccaactactttgccttcagacctgatgctcctgtggttgggcctgccaagcctgccctccccagtggaagaagagggccgtcttgtgaaaggcctcaggctgacccttgcagcaccagcctctgaggtactgccagactgggaagaccctcccagccacccaacagcgtgggcccagcccaggacacatcagcccgacactccaaattctatcaagagtggcatttattctccttgtggaggtgcggtgctccggggagctggtgctattgtgcttaggaaggaggtctgtccgtccgtccgtctgtccggccggcctggccccaaatgggggcggaagaggggcacggcccgagtaaaaatcccggcctattccgggtgggaatatgtacaaggcggcggggcacaggcgggggtgggggcgggcgggccggcggccgcagcccccacccgagggcccccgcacctcgggccctacttgtagaatcagtacaaaataggtgctacctaaacgttccttctacctgaaaaaaaaaaaaaaaaaaaaa

SEQ ID NO: 208 - DNA, 1396 bp, Homo sapiens
aagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccrtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaaaaaaaaaaaaaaaaaaaaaaaaaaaaaaaaaaaaactcgagggggggcccggtacccaattcgccctggagttcaagtagacatcaa

SEQ ID NO: 209 - DNA, 1886 bp, Homo sapiens
ggcacgagcggcacgagggaaaatagagagcaacttaattatgttaaggttgactcaaactttttttttcatttcacagacacttctagattggttcttagcagcagctcttgctcttcctaatttgtgttccccattagcatctaatttcaagagcaggcaaatctcatctgttcccatccagcccagccagggaacctccagagttgctttgcagatatggtgtggatcctgcagaatgaggatgagctcttccacgatccacattcttgccctttaaaaaataaagcgggtaggcagcggggtggcggtgtggggtgtgtggggcaagagctagagcgttcctcctcagtgagtttgatgaagggagaatgtaaaacttggctgaacttagccctccaggaaagggtagccagaatgttgtattaatttagtgatgtcttcaaaagggtgtggtggaggaggagtctcattcagaatgagaagctgatcccagctcccaggaaatcgacacagttgctggtgtgtagtggtcagcactagccgagtccctatttgtagcttcatgctgttttttatactgttgtgatgtaatgtacatctgtgttcacccaagctgcctatgcaatgacttctataaagctcagtttttaaacacagtctcttacagataaaacaacagaaccagtgccagaaagcagccttcccttacatgggcacttctgccaagcatatgagttcattgccttgaagatcaaagtcaaagagaaatggagagggtgttgaaatgatcagcgaaaattaaatgaaaatatattcttattggaagctgatgctctattatcaataaaggacccatagcaaagatacatagaggagtgatttttcaagcagtcaagagcagaactacgaaggttttgagatggtgtagctgccaaagaagtcacccctggctgtcccccatctcagtgagcctgagttgaatgtttcccaatgtcatatcccacagggggatacttagtgcccacagcatgtgatcggtagctgataaggaagcattggaccagaatgtcatggaagaaacaaaagcccacttatcttccgcggcaatatgtttatgaacatgtgaatcattgttcatataactgtctcaaatacttggctgaaaagtagactgtttggtgttaagtttcgacttattttcgagggaggatgggatatggttatacaccatatgaaggattttgtgaataaagagtttcaaaatattttgggaatagtagttcggcatttattttttttcccagtcacatttcatgagcaacaattttatgtttaaggtagtatctgactaacctactgatgctgtctattcattccattagcatacttatgccatgggtaaaagcaatccatctagaactctttcaaccattttttagtttgtctttgcacactctagatagcatttctgaaatcatctgcaggaacagagttcctgaaaagagcaatggtctagagcaggctttctcagacttcagtgtgcaccagagtcacccaggatcttgttaaaatgctgattctgaggccaggcgcggtggctcacgcctgtaatcccagcactttaggaggctgaggcgggcggatcacggggtcaggagagcgagaccatcctggctaacagcatgagaccctgtctctactaaaaatacgaaaaattagccaggcatggtggcaggcacctgtagtcccagctactcaggaggctgaggcaggagaatggtgtgaacctgggaggtggagcttgcagtgagccgagatcgcgccactgcactccagcctgggggacagagcgagactccacctccaaaaaaaaaaaaaaaaaa

SEQ ID NO: 210 - DNA, 2971 bp, Homo sapiens
gacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaaaaaaaaaaaaaaaaaaaaaaaaaaaaaaaaaa

SEQ ID NO: 211 - DNA, 1337 bp, Homo sapiens
  misc_feature (1337)..(1337): n equals a,t,g, or c
cttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggyccctggmagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctrttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaaaaaaaaaaaaaaaaccccgggggggggcccggn

SEQ ID NO: 212 - DNA, 1336 bp, Homo sapiens
ccacgcgtccggagttccacaaaatttgttagtcatcaaataatagagtttttcttaagtgaccacttacatactcatctacaataaaccccaactaactaatttttcactttgtgtacctcatgctaatatccgtggacagtaatgtgcctgttgtgttccttttgcttttcatccttgtgatcttatgtcacatggaatgtaaaggccacatatatatatgtgtgtgtgtgtgtgtgtatatgtatatttttaagaatatttagtctggatttcatgaaattgacttctgaaataatttgcctcaattttgtttcctggtggtttgagaagaaagttcctgtggtgaaatgaaaaggggataaagggaagtacttattttaaaacataagtaacttgtggattgttgaatactggaaaaagagtgttacttccccgttaacctacgcctcgtgtaatccttcaggttggaagtcggatcgcagaccgtgtatatgacatacccagaaatttcccccttgctttggatcttggttgtggaagaggttacattgcacaatatttgaataagcttcagttattccattgcaggaaactattggaaagtttttccaagctgacattgcagaaaatgctttgtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaaaaaaaaaaaaaaaaaaaaaaaa

SEQ ID NO: 213 - DNA, 1129 bp, Homo sapiens
gctgcttcccaaggaccatgaaactcctgctgctggctcttcctatgcttgtgctcctaccccaagtgatcccagcctatagtggtgaaaaaaaatgctggaacagatcagggcactgcaggaaacaatgcaaagatggagaagcagtgaaagatacatgcaaaaatcttcgagcttgctgcattccatccaatgaagaccacaggcgagttcctgcgacatctcccacacccttgagtgactcaacaccaggaattattgatgatattttaacagtaaggttcacgacagactactttgaagtaagcagcaagaaagatatggttgaagagtctgaggcgggaaggggaactgagacctctcttccaaatgttcaccatagctcatgacttcctctcggctatcactcacccctgtcctcagagtgataaactaagtcacatacagataaagcactgaaaacaccacagtgaccctcccaccccccaccaatatgtaattctattaatagaaacagctgtgtaaagaagtctaaaattttcactatttccaatgataaactcttcagtgctcttcttgaaatgtcacattatttcccaacaagttatacctatttttagtattcttgttgctagtgccatgcacaacttcaatagctagttgctattccaacaacaatttcttcatgtatcgttctgtcttctcaacagctgtctttcatggcagcataagtggtcatgatcaaaattctaaatcttgcatctgtgagagtagctactatgacactaaaagctttttttctagaacaggagacacttcaggtgaagcattcattctcctactaactatggccttggagccaggttttatctctcactgtaggaaattggccgccccaggtgtgagctatgaagactcctttttgccccagtggctttggggttgaaatgctgtcgaaaagcttttatggctctgtagacccatctttttgaccaagccttgatcacacatggacatccaagggtaatcatggacccccaattgtgggtgaaaggatggatcatttatctacctgattactgagagctttatttgtctccctctgatagcaaaaaaaaaaaaaaaaaaa

SEQ ID NO: 214 - DNA, 799 bp, Homo sapiens
ggagacggtgggtgaccagagagtcctgtctatcctaggaggagaacattcagcccaaatcccagccccatcatgcacagatcagagccatttctgaaaatgtcgctgctgattctgcttttcctgggattggcagaagcctgtactcctcgtgaagtcaacttgctgaaagggatcataggtctcatgagcagactgtcaccggatgagatcctaggcttgctgagcctccaagtactgcatgaagaaacaagtggctgcaaggaggaagttaaacccttctcaggcaccaccccatccaggaaaccactccccaagaggaagaacacgtggaacttcctgaaatgcgcctacatggtgatgacctacctcttcgtatcctacaacaaaggggactggttcactttttcctcccaagtgttactgccactactgtaacttggaactggacatcagggatgatccctgctgttctttctagtgagcctgctccatctcagcttagccttcacaaggcctccatctcccaggcattctaacctctgaagaaagctctctgtcccctggactgcctgtgtggagggtaatgaactgggtcctttaaggaatggcacctgggtgcccagaggcatggccagaaggtgtctgtgggggccatgccttagggggatgcacccagggcggctgagagagcaactgcaggagtttcccctaaaatctctcctccagatcgttctcgaactttccccactacttccataataaaatgtatacttgttgaaaaaaaaaaaaaaaaaaa

SEQ ID NO: 215 - DNA, 847 bp, Homo sapiens
tggtggcggcatacatcgccttcacaatggcgctctgcagctgcgtgttctgcagcgtgtcgagcatcttcatctgctccatcacgctgtaaaacacatttgcaccgcgagtctgcccgtcctccacgggttcattgcggcgcagtgtagacctgggargatggscggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtmmwgtgacctcggccagtgtccacccacctcgctcagcggctcccggggcccagcaccagctcagaataaagcgattccacagcaaaaaaaaaaaaaaaaaactcgag

SEQ ID NO: 216 - DNA, 1689 bp, Homo sapiens
actatagaagtcgcctgcagtaccggctccggaattaagggtcgacccacgcgtccgggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattatttycacatcattctagtatatggactttggaaacaaaagacattgttctatttatagcattctttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaagtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaaaaaaaaaaaaaaaaaaaaaaaaaaaaaaaagggcggcc

SEQ ID NO: 217 - DNA, 1000 bp, Homo sapiens
agcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaaaaaaaaaaaaaaaactcgagggggggccc

SEQ ID NO: 218 - DNA, 990 bp, Homo sapiens
  misc_feature (4)..(4): n equals a,t,g, or c
  misc_feature (916)..(916): n equals a,t,g, or c
  misc_feature (958)..(958): n equals a,t,g, or c
  misc_feature (971)..(971): n equals a,t,g, or c
gcangagagctaccaagtggccgagctggcttatraccctagggcagtctgcccccaaaacccatctacttggttgtccccagaatgggttggcttgggagaacttgccttgctcactcccatttagactttattagtggagccctcctcttgacttttgcctatttccttgtctttcaggtgtgccctgtgattaataaatggctctacaacctggaccagcatgtggttaaagagttgattagtaagtgctggaggtgggaagggacaggaacactccagaagaaagctcagaaccctccctcaccctttgtatttcatttccccttacctcactctggcacttctcctagaccaaaaatctctttcctgctgaagtagaatggtccctaataataacaaccttaataataaactcagctgacattaactgagggagcccagtgtgccaacatgaagcactgtgcctgcactagcaattgaacgtgcacctttagctaaggacgtgctggtttcaattctattcttgctcccaagcctacagcagctgagatatgaatggaaacttctccaggggagaaaatctgcccaattctgcctttgtcctcccctaaatttgtatgagttaaatgatgggcagaaaattggtctgttttcagcccagacaaacactgcctcctttcagtagtcgctacctcaagcatccaaagttttcatatctgccagaactcaaagcaaaaaatgcaagattgaatctcagcagctcaggcccccagcaggacttcaaacttccaccaccaaaaaaaaaaaaaaaaaaaatgctgaattgaaaggtatatgccttcattcactgaatattcactcgtcctgccaagtgccagatgccaragtttctaaaattcccccaaaggggggnccgggtacccaattcccccctattagtgaagtcctatttacnaattcccttgggnccgtccgtttttaacaacc

SEQ ID NO: 219 - DNA, 420 bp, Homo sapiens
ggcacgagagagagcagagctatacatagctatccaggtctaacttcacgaagaatagaatggtttcttttcattttcaatgtacatcatactttgtcagacttttttttcagttgcagctcttcgttggactggtgatagtattggctttattaatctctcattctctcacttattcattccacaaacatttgtagaaggccaccaagctctagggagaggaaaatggttttataaattagtgctttctgggataaaggaaatttataatctgtactacttaatagtagccactagccacatgtggttttcgaacaagatttccatcacctctccaaccactttctcctcattggtcagatctagaccccgagaaactgttcctttcattgttttctccgccttctacaaactgagata

SEQ ID NO: 220 - DNA, 1090 bp, Homo sapiens
  misc_feature (8)..(8): n equals a,t,g, or c
  misc_feature (28)..(28): n equals a,t,g, or c
  misc_feature (43)..(43): n equals a,t,g, or c
  misc_feature (54)..(54): n equals a,t,g, or c
  misc_feature (95)..(95): n equals a,t,g, or c
  misc_feature (545)..(545): n equals a,t,g, or c
  misc_feature (863)..(863): n equals a,t,g, or c
cattgacntcaatgggagtttgttttgncacccaaaatccaangggactttccnaaattgtcgtaaccaactcccccccattgaccccaaatggncggtaggcgttgtacgggtgggaggtctatataagcagagctcgtttagtgaaccgtcaagatccgcctggagacgccatccacgctgttttgaccctccatagaagacaccgggaccgatccagcctccggactctagcctaggcttttgcaaaaagctatttaggtgacactatagaaggtacgmctgcaggtaccggtccggaattcccgggtcgacccacgcgtccgccagcctggaggcccagacgtggcgcagcgactcggaggttcgcctccagcttgcgcatcatctgcggccgggtcccgatgagcctcctgttgcctccgctggcgctgctgctgcttctcgcggcgcttgtggscccagccamrgccgccactgcctaccggccggactggaaccgtctgagcggcctaacccgcgcccgggtagagacctgcgggggnatgacagctgaaccgcctaaaggagagkgaaggctttcgtcacgcaggacattccattctatcacaamctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcgganctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaaaaaaaaaaaaaaaaaaaaaaaaaaaaaaaaaaaaaaaaaaaaaaaaaaaaaaa

SEQ ID NO: 221 - DNA, 1676 bp, Homo sapiens
  misc_feature (798)..(798): n equals a,t,g, or c
  misc_feature (927)..(927): n equals a,t,g, or c
  misc_feature (944)..(944): n equals a,t,g, or c
  misc_feature (974)..(974): n equals a,t,g, or c
  misc_feature (1035)..(1035): n equals a,t,g, or c
  misc_feature (1058)..(1058): n equals a,t,g, or c
acgagcagattcccaagaaggtacagaagtctttgcaagaaaccattcagtccctcaagcttaccaaccaggagctgctgaggaagggtagcagtaacaaccaggatgtcgtctcctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccagggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtangccctgccttcctggccactgatttctgcatgggtagaccatccaagactgcagcgggtagaaggtggcagttcttcatgggagtctttttaacttggtgcctgagttctctcctaagcaagtggccanttgcctccacctcagtncttccatctttgggtgggggacaggggccnagcaagcatctcagcctcctacccacaattccactgaacacttttctggccctactgcacntggcccccagcctccatccttgngctggtagcctctcacaactccgtccttgccctttgccttccacttccttccatctcatttctaaaccccaaacagctcatctctaaaaagatagaactcccagcaggtggcttctgtgttcttctgacaaatgattcctgcttctccagactttagcagctcctgatcccattcttggtcacagctctagccacagcagaaggaaaggggcttgcagaagaatatagcaccgaattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctaaaaaaaaaaaaaaaaaaa

SEQ ID NO: 222 - DNA, 1569 bp, Homo sapiens
  misc_feature (341)..(341): n equals a,t,g, or c
gtattggccaggctggtctcaaactcctgacctcgtgatccacccaccttggcctcccaaagtgcagagattacaggcatgagccactgcacctggcctcaagaaaaattatatatcacgtggaataggatagtagtctctgcactgattttcgttgataatggctgttcttcttatcaccattttgctatttctttgtctgggctattacagggttattacagaaatttccagaaagacccctgcctgtcgaatgtttacttcaagcttgagctcctggtatattatgaggaaattatatgataccccaggagaggtcttcctttcccatgccattgtanaattcctaaagtaaaattaatttgccttcttgtcaaagaaggagccaatgttgttttaaaattttagcttgagagataggtggggaagaaattaaatagacaagtaatcmctattcagaagagaagggagagtcattgtacgaggcccaagatacttgcccaaaaatatcgcagagaaaaactagtctttggggtcctattttttgagtggaacatttgagttatttaaaattagaattttattttggtcagattagaatttctagggtatgtcatatgtgtttttaaattgaaagctcttaaaactcctattgtagtttaatgtcattatccattaatttacataaatctgatttggatctctattttcatcgtagactgtgtaggggcaatttttcctaaaggttctgtgacatagtgctaccttttttttaaaacctgtcttgcccaggcattattgagtgccccctggtgccagcatgtgtatttcacgactgtatcaacaaatcatgatcatcttctctggccattgtgccctttcagattccaaacttgttacctctcagtccttcctacaaacttagaaagtctaatatcttaatgtttacttatgtagcaacctccctttctcccatccctaaatcctcttgtaattaattattttcctttggaactttttaaatctacaatttccttataatatggtaaccaatattaattttcttgttctgcgccaagtttgattttatacaaattgtttccagtttgggtcatgagcacaaaaccaggtatttttaaaaatctatataacccttcaatgaggcagtattaattttattaactcattaattcaaccaataattcttgattgtttactgtgttagatattggggtatccccaatacctgacagctgtgagcaaaacaaatgccctacacacatgaggtgtacagtccagtagaaaagataaacaataagcaaattaatagataatatgatgtccaataaggacttcaaaggaaaataaagcagagtaaagagccagagaatgacagtgagctgtttttcacatgagtcatcagaaaaggcctctttaaagaattgacatttgaacagaaaaacgaatcaagggcgtcaactgtttattgcttttattgcttaccatttgaccaagcaattctacacataggattcaccctaaaaaaaaaaaaaaaaaaaaaaactcgag

SEQ ID NO: 223 - DNA, 1381 bp, Homo sapiens
ggcacgagcaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaaa

SEQ ID NO: 224 - DNA, 1251 bp, Homo sapiens
gcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagasagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgaraaaaaaaaaaaaaaaaaaaagtcgagc

SEQ ID NO: 225 - DNA, 1345 bp, Homo sapiens
tctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttattttgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagctacggaaaggcccatttctgggcccactgagctgcactgggattcttcactctgcccctcacttcctttagggcaaataacacagcagaaccacgtgggtattttagtacttttttttatattaaaagaattctaatttgcaaaaaaaaaaaaaaaaaa

SEQ ID NO: 226 - DNA, 1347 bp, Homo sapiens
  misc_feature (83)..(83): n equals a,t,g, or c
  misc_feature (334)..(334): n equals a,t,g, or c
gggcagccctcaggccctccggcagcctggccgggcccgagtggccatggcagcactggtgtggctgctggcgggagcacatngtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaaggctgtgcccctggacctggcacaactggttactaccaccacacctctgttcancctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagtgccctgctgcaggaggagaggctggacgcggtgaccctgctttacgccacctcgctgcccagcttctgcctgctggcgggtgcagccctggtgctggaggctggcgttgccccaccgcccactgctggcgactctcgcctctgggcctgcatcctgctcagctgcctcctgtctgttctctataacctggccagcttctccctgctggccctcacctctgccctcaccgtccacgtcctgggcaacctcaccgtggtgggcaacctcatcctgtcccggctgttgtttggcagccgcctcagtgccctcagctacgtgggcatcgcactcactctttcaggaatgttcctttaccacaactgcgarttcgtggcctcctgggctgcccgtcgggggctgtggcggagggaccagcccagcaagggtctttgagacctgggggatctcaggagccacctgggatggccctggcctgaatccagcctccgctgtggccatagaaggaatggagaacagggctgggcatggtsgctcacgcctataatcccagcacttccagagtccgaggtgggtggatcacctgaggccaggagttcgagaccagcctggctagcatggcaaaacctcatctctactaaaaatagaaaaattagctgggcatggtggcgcgtgcctatagtcccagctacatgggaggctgaggtgggaggatcacttgagccctggagatcgaggctgcagtaagccaagatcgcatgctactgcactccagcctgggagacagagcgagacgctgtctcaattaaaaaaaaaaaaaaaaaccggcacgtag

SEQ ID NO: 227 - DNA, 642 bp, Homo sapiens
  misc_feature (41)..(41): n equals a,t,g, or c
  misc_feature (49)..(49): n equals a,t,g, or c
  misc_feature (64)..(64): n equals a,t,g, or c
  misc_feature (607)..(607): n equals a,t,g, or c
  misc_feature (621)..(621): n equals a,t,g, or c
taaaggggaaacaaaaaggctgggaaggcttccaaccgcgntttgcggnccggcttctaggaantagtggaatcccccgggctggcaggaattcggcacgagaaaatgacttcagacaaatatgatcaatctctacagtcccctgatgaatttcacaggttcccaccaccatcagttctacctattcatctcatccatgctcattgttctgcctctttcctgttcctatggatgccctggcatgtttgtttctttctttctggcctcctatttccctcccctcagacatcacttcagcatctgtgccttctcacttcccttatcctgggtgttaccatttcagcctatgagcatgccattaatttgccatctttacaaaattctctcttgacttcacatccctctgtagctgccctctcccttctctcctcttctttacaacaaaactccttaaaagaactgttggctgggcacagtggttcactcctataatcccagcactttcagaagccaaggtgggaacatcacttgaggccaagaggtcgagaccagcccaggcaacacagtgagacctcatcactacaaaaaaaaaaaaaaaaaactcgangggggggccggtanccaattggcctaaagtgagtc

SEQ ID NO: 228 - DNA, 669 bp, Homo sapiens
cagcctcattttctcagtgccccagaggtctaggataggatttctaaactggaatcatccttaatcaccttgaagatcccttaagaggcatttgactggtgctgccgtctgtgtcctcaaagcaatgctggtggcatcgtcctgtgtacacatgcagagctaatacccaaactaaaaactgggtaactggccctgaagtgcttcccaatcagtaagccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaarawraaaaaaaaaaaaactcgag

SEQ ID NO: 229 - DNA, 1271 bp, Homo sapiens
ggggctgggccctgctcaggtggctctctccttgcagggaccggcgatgctctgcaggctgtgctggctggtctcgtacagcttggctgtgctgttgctcggctgcctgctcttcctgaggaaggcggccaagcccgcagagaccccacggcccaccagcctttctggggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcaggtggggggatgggctagggccggcactgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggaggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaacccaaaaaaaaaaaaaaaaaa

SEQ ID NO: 230 - DNA, 1448 bp, Homo sapiens
aaaaaaaaaaaaagcccacctgaaagcctgtctctttccactttgttggcccttccagtgggattatcgagcatgttgttttttcatagtgcctttttccttatttcaagggttgcttctgagtggtgttttttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggagstttaagctccagctttaagggttgtgagccccttggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttmaaaaaaaaaaaaaaaaaaaaaaaaaaaaaaaaaaccccggggggggccccgggccccaattccccccaa

SEQ ID NO: 231 - DNA, 802 bp, Homo sapiens
  misc_feature (105)..(105): n equals a,t,g, or c
  misc_feature (730)..(730): n equals a,t,g, or c
  misc_feature (755)..(755): n equals a,t,g, or c
  misc_feature (757)..(757): n equals a,t,g, or c
  misc_feature (777)..(777): n equals a,t,g, or c
cgtgcctgtagtaagctcatccctgcctttgagatggtgatgcgtgccaaggacaatgtttaccacctggactgctttgcatgtcagctttgtaatcagagattntgtgttggagacaaatttttcctaaagaataacwtgaycctttgccaracggactacgaggaaggtttaatgaaagaaggttatgcaccccmggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgctyctttgtattgttgcatttagtacaatcagtgtttaaacttactgtatatttatgctttctgtatttaccagctattttaaatgagctgtaactttctagtaaagaattgaaaagcaaatcctcactaaaggatacacaggataggataaagccaagtcncatcaacattaaaaaatactaaaananaaaacacaaaaaaaaaaaancccggggggggcccggaacccattc

SEQ ID NO: 232 - DNA, 470 bp, Homo sapiens
ggcacgagggaaatcttgcacataggcaggtaaataattataaatggtgaagtggattattctgagctgcttaattttaaagggaaagagaactttaaactcttcaaccttttatgctgctaataagagttccacaatcaatagaaatctatcttggcaggcacttccttttacccactagaattttttcccttgggagttcacgatccccagaaactgtgatatgagccattcaatattgatgtactaaaacagtgctctgcttaaatacagtttttcaacatacagtcttggaagaaacaaaatccaaaataaattccaatagtccagtaacaggaataaagacaactattgcaaattaaatcttacagacttatatgaaagctgttgttaacagctgggtactagttatttgaaaagtttctcgtgccgaattcgatatcaagcttatcgataccgtcgacctcgta

SEQ ID NO: 233 - DNA, 1020 bp, Homo sapiens
  misc_feature (3)..(3): n equals a,t,g, or c
cgncacgaggtgaagttcaacccaatgcaactttccttcagtctttccgtgaaagcgcctgtgaaaaatgaggtcatatttccctttctcagtctgccccttcccgttttgctctccggttttcttctttgtcttcacagatgtttacctatgttttttctttgtttttgctgttggaagacatctaagtgatccttttcccattctctttttcactcataaatgtcctgatgtttagcaaaaggcagttctctttgctacttgagcttgtaaactgttgttaaatgagtaaccaaaaggaaagtccttgcgaagttggttaccatttcagatacaagaaccgtttatcttcccacgctgacgaattttgcgagtgagatgattatttttccttgtgtttgtaatttatttaagtaaattccttgtttgtttttcttttcagtacaccaggggtatatattttcaatatgacatgtacctttggttcagggctaagttagagtctgaaaaatgaagcctgtaggattcatggcagtgatctaattgtgattcatcttactgattgtagggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatctcgtgccgaattcgatatcaagcttatcgataccgtcgacctcgtagggggggcccgtacccaatcgcctgt

SEQ ID NO: 234 - DNA, 1881 bp, Homo sapiens
  misc_feature (70)..(70): n equals a,t,g, or c
  misc_feature (126)..(126): n equals a,t,g, or c
  misc_feature (1860)..(1860): n equals a,t,g, or c
atttttccttttccttaacaatacctttggccatttttttccagttcactatgtttgtatactaactttncttcagccttttaatgcgaagcaactagtagagcatgctttcaggatctgacagcnctgctagtagagcgaagtatttattaatacagaattaaccttmgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgttycctggattttataacatacatgtgcagaaatgtattcaaatgaaaggaagcatacctttatcaagatgctattaaaattgaacatcaagtataaaaaaaaaaaaaaaaaaaaattnctgcggccgacaagggaattc

SEQ ID NO: 235 - DNA, 1450 bp, Homo sapiens
ccacgcgtccggcccatatcacttaaaaagttcaaagccaaacaatgtttaacctctccttttttacattgtatggactttgtatgctgaagcttcattcagcctcctcctggttcacattgttattgttaatatcattatttttgtctgtcgtttattgtcagtctacaaattagatattattattgtttttgttttatacaggcaacatttatctggatttgcatagatgtttaccattttctttactcagtgttttatcaaatacatcctttaggaattcctttaatttggtctcttgttggcatatgttcagttttcatttgtctattaaatgtttatcacttttttcgtgataggttgttctgctgggttcacaattttaggttgccagttctgtttttttgtttgtttgtttgtttgacacttggaagatattattctagtgtcttcaatattctgtctttggtctttggtcattctaattaccttttctttgtatatgatctgtcccttctccatggcttcttttaaaatcttctctttatctttggtgtttttcagttaaatatgtaatagaactaggcactgatttgtttatatttatcctgctcgagacacatgatgtttcatgtatctgtggctttttatagtttaaaataatttctggaaaagtcatagtcattatctctttaaccgctccctctcttccattctctttgttctctcttcctcgaactcctgttagtcatttgatcctccatatctctgaatatttttgtatttcttttattatttatttcttgtctctgctacattttacattgagtaaaagtgggatgtgacagtgggaaatcattagtgacttagaaattccagttggtcattgggccaattttgatgctaccttctctcttttatttctcactttaaaataaaatttgcaaaaacaaaaaattaaatatagtatgagtccagttactggcctaaggagctaaaagcattctgggtttgtatgaagacagctgagttataacaaatgagagtactgttgtgtgactgcattaattattccctttttaaatgtacaagagcaaggcattctacctgactgtgttattgagctctgcagcatacatgtgacagagctaaaacaaacaagcaaacaaaagaaaccacagctttaggatactctgttcatgaatatagcctgaaaatgataatcaagaagtaaacttttaccagtattaaggaacattaagctgcctatctctcagtgaatttcagaatgatattttaaaagttagtttaggctgggcactgtagctcatgcctataatcccagcactttgagaggcagaggccaaggcaggaggatcacttgagccccggattttgagaccagcctgggcaacatagcaagacactgtctctaaaaaaaaaaaaaaaa

SEQ ID NO: 236 - DNA, 2407 bp, Homo sapiens
ggcacgagtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggatttttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacaattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaaaaaaaaaaa

SEQ ID NO: 237 - DNA, 795 bp, Homo sapiens
  misc_feature (791)..(791): n equals a,t,g, or c
ggcacagtgcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactgggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgmaaaaaaaaaaaaaaaaaaaaaactcgagggngggc

SEQ ID NO: 238 - DNA, 648 bp, Homo sapiens
ggcacgaggtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaaaaaa

SEQ ID NO: 239 - DNA, 1169 bp, Homo sapiens
ggaatgtgagtgcaaatttgaatttccatgtacacatgtccccgtgtgcacatatctgtctgtatgtgctagtgtttctatgtaatgtgactagatgtaaatgtgttagggcattcacaacctgggacacagagaaagtgaaatattttatggcacactggagtaaactgaagagggttaggggtactagagttgagtgaaaaggaatttcttacattttcctcatattatacaattatgggaagaaaattaaaatgcagaattttaggggagttattaaatattgaatttgtgtacaactttcaaatgaaatcttttcagttttttatgacacacttgagctcacttctagaaacatgtcttagtctgttttgtgctgctctaacagaatacttgagactgggtaatttttaacaagcagagatttctttcttacagttctggaggctaggaagtccaaggttgaggggcatgcatctagcaagggcctccttcctgcgtcatcccatagtgaagggcagaaaggcaagagaacacgcttttgcatgagagagagaaagagagagaagagaagggaagggaagagaaagaagagaagagaagagaagagaagagaagaaaagggagccaaactcatctatttatcaggaacccttcttatgatagaaacccactcccatgaaaacaggattaatctgtttatgaggacagagtcctcattacctcatcasttcttaaaggtctcacttctcagtactgctgcattggggattaggtttccaacacatgaacttcggaggacacattcaagccgtagcattctyccttgactcccmaaatccatgtccttctcatgtctaaaatagattaatyccatcccaatwgccccaaagtcttgactcgttccagcaccaactcaaaattccaaagtccagagtcccatttgaatcagacaggagagactccaggtgcaattcatcctgaggcaaatttctctccagatgttagcctatgaaaatagcaaattactttcttccaaaatacaatggtgggacaggcataggatagacattcccattccaaaagggagaaataagcaagaagaaaggggtaactggtcccaagtaagtccaaaatccaacagaaaaaaaaaaaaaaagggcggccgc

SEQ ID NO: 240 - DNA, 1088 bp, Homo sapiens
ggcacgagctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagttttttttttttttttgtcatctctgaggtggaccttgtcacctgtggttattggggccaaggcggactcagctcccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaaaaaaaaaaaaaaaaa

SEQ ID NO: 241 - DNA, 2213 bp, Homo sapiens
ggcacgagcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcataaaaaaaaaaaaaaaaaaactcga

SEQ ID NO: 242 - DNA, 796 bp, Homo sapiens
gaaaaaaaagaaaaagccaaaaaaaaaagaagaagaagtaccactgctaggatttgaacccagatctagctgactcaagaaccatgccctatctctgtgtccatgttgtcaccacttaatcacttgtattttcccttcaggtttctctgtatgctgtgttctctcccaagagtggtcttccaactcacccctattaaggaagctttcccaagccaggagcttacctttccgtgcacacattgaatgatgatcatttgtcattctgtcttgccttacaaaagaggaccagctccttgaggataggaaccttgtccttatctccctgttcccctgtatgggggccagctcctggcaggtgcatagtaaataatgagtgataaacttgttggaaagaccatgcaggaaccaagcaactcttttcctctgcctcaatgcagttagttcaagaacttactaagaaaagagttgttggccaggcacagtggcacaggcctgtaatcccagcactgtgggagaccaaggcaggcaaattgcttgagctcaggagtttgagaccagcctggacaatatggcgaaaccccatctctatgaaaaattggaaaagtagccaggcatggtggcatgcacctgtggtcccagctactttggaggctgaggtgggcgaatcactttagyccggggaggtcgaggatgcagtgagctgagattgcgccactgaactccagcttgggcgacaaaatgagaccctgtctcaaaaaaaaaaaaaaaagaaaaaaaaaaaaaaaaaaaactcgta

SEQ ID NO: 243 - DNA, 1076 bp, Homo sapiens
ggcacgagcacagcctcaggccctgccccagacctgcagaatcagaaactctggggtgaggcctggttatctgctgtaacagaccttccagtgggttctgatgccctctagagcaggagaaccactagcttagaggttgcagtatgtttggcatcttgccatttgtgttagttcagaggaatggctgacccccatgtctcatttctaagcttcaggcagcttttctcctgggcagctgtcattctgttgaggggaatcctggggactgtggctcctcctccctgtccgtgtgtccttgatctggcagtctacccccttcatctccccgtggaggctccatgcctagaggtggtcttcaaacagaagaatggcaaagataattgtctcgtgttttaccctgaccccattcctttaagagggtcacttcttggcccattcatttaaaaaccaatgtcatagttctgtgattccacctatcagacagtgccacgtccaaggcggggctctcacctccctgggaagagagactgttgctgtctgtgcttcctgtgttctccagtcccacgctcccacggacccacgcccttggagactccctcggtgtcccagggcttctggtgtgttcagagacctccacactcaacgaccactggtgctgcagaagggccggtgcttacattccaattaacagacgcttttcccatctaatgcctcttgccttctcctaacaccacctcgggagtgtttatgtctattctaagtgaatttcactgtgtgaaaaaattcacacctgttgtcccagcgatttgggaggccggggcgggtgtatcatttgagcccaggagtttgaggctagcctgggcaggatggtgaaaccccgtctctataaagaaattttaaaaattagctgggcatagtggcacgtgcctgtagttccatctactggggaggctggggtgggaggatcgcatgagcccgggagtttgaggctgcagtgagctgtgatcgcagcactgcactccagtctgggcaacagagcaagaccctgtctcttaaaaaaaaaaaaaaaaactcga

SEQ ID NO: 244 - DNA, 532 bp, Homo sapiens
  misc_feature (434)..(434): n equals a,t,g, or c
  misc_feature (528)..(528): n equals a,t,g, or c
ggcacgagtaaaaggtgccatctatgaatcagaaagtacgcccttaccagacaccgaatctaccagctcctggacagaacagactaagatacattccaagaagcagtttctttggagacagaggcgtaactgtgcatatggacaaggtttatatttctgttcaaagtggccatccatatgcttctaggcttcctttgtctctggtatcaagtgtatgtatgtatgtatgtatgtacttatttatttatttatttattattttctcttttttctctgccccatatgatctgcaagaaaagtgtcaagtttataatgagctccccaaagccaccatctgggtagcctcacatctttttcatcccctgtgcctcttccctgcttttgtcctactctagccagactcgtgccgaagggggggccggtamccaattcgncctatagtgagtcgtattacaattcactggccgtcgtttamaaagtcgtgactggggaaaacctggsggtacccaacttwaatcgccttgaagnaaat

SEQ ID NO: 245 - DNA, 762 bp, Homo sapiens
ggcacgagtgcctctacgtcatgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgcccatgttattcgcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagaaaaaaaaaaaaaaaaaaaaaaaa

SEQ ID NO: 246 - DNA, 1575 bp, Homo sapiens
gtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaagrtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctamaaaaaaaaaaaaaaaaaaaykcga

SEQ ID NO: 247 - DNA, 1839 bp, Homo sapiens
aattcggcacgagtgcaggtcgactctagaggatccccgctaagaagctagggctattggtcttcccatacacacatcagaactgaggcaccatgcaagggggccagagacctcatctcctcttgctgctgttggctgtctgcctgggggcccagagccgcaaccaagaggagcgtctgcttgcggacctgatgcgaaactacgacccccacctgcggccggctgagcgcgactcagatgtggtcaatgtcagcctgaagcttaccttgaccaacctcatctccctgaatgaacgagaggaggccctcacaactaacgtctggatagagatgcaatggtgcgactatcgcctgcgctgggacccaaaagactacgaaggcctgtggatattgagggtgccatctactatggtctggcggccagatatcgtcctggagaacaatgtggacggtgtcttcgaggtggctctctactgcaatgtcctcgtgtcccccgacggttgtatctactggctgccgcctgccatcttccgctcctcctgctccatctctgtcacctacttccccttcgattggcagaactgttccctcatcttccaatcccagacttacagcaccagtgagatcaacttgcagctgagccaggargatgggcaagccattgagtggatcttcattgacccggaggctttcacagagaatgggragtggsccatccggcaccgaccggytaaaatgctcctggactccgtggctcctgcagagraggcgggccaccagaaggtggtgttctacctgcttatccagcgcaagcccctcttctacgtcatcaacatcatcgccccctgtgtgctcatctcctcagtcgccatcctcatctacttccttcctgctaaggcgggcggccagaaatgcacagtggccaccaacgtgctcctggcccagactgtcttccttttccttgtggctaagaaggtgcctgagacctcccaggcagtgccactcatcagcaagtacctgaccttcctcatggtggtgaccatcctcatcgtcgtgaactctgtggtcgtgctcaatgtgtccttgcggtccccccacacacactccatggcccgtggggtccgcaaggtgttcctgaggctcctgccccagctgttacggatgcatgtgcgcccactagctccagctgctgtccaggatgcccggttccgactccagaatggctcttcctcagggtggcccatcatggctcgagaggaaggggacctctgtctgcctcgaagcgaactcctctttaggcaaaggcagcgcaatggattagtgcaggcagtattggagaagctagagaatggtccagaagtgaggcagagccaggagttctgtggcagcctgaagcaagcctccccagccatccaggcctgtgtggatgcctgtaacctcatggctcgtgcccgacgccagcagagtcactttgacagtgggaacgaggagtggttgctggtgggccgagtgctggaccgagtctgcttcctagccatgctctccctcttcatctgtggcactgctggcatcttcctcatggcccactacaaccaagtgcctgacctgccgttccccggagacccccgcccctacctgcctttgccagactgagccaaccaatccctcctgggccctggagtcagctatgagggccatgctgtttgtagagctgtatcccgtgttgatgctgagtgtgctcttggggaaatacccaaggcttcctgggagaagatagagaaataaagagacagaggggaaaaaaaaaaaaaaaaaaaaaaaaaaaaaaaaaaactcgtag

SEQ ID NO: 248 - DNA, 1103 bp, Homo sapiens
gtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgcttgttgcttttaaagttccttctgttgttctgcttcccactgatttcataccagctcatgaatggatcattacagtctctccagaggcttagaatgattcagaatgttcaatgcatagttctcaataaacaggaggcagaatttttaatgggtatttcttttcagatatatgattggtctctaggtttttgataataatatggtcttaaattcataattactagcagagattgataatttggaaacaatggtagtgaatgaaactgaagttgaaaaacggctgctacttatgtcactaatcagaccatatgaatagcagaagttgagcaatttcaaagtaaaactgatatttttatttccaaaggaatttagacatttgaaaataattgacatacattaagttttaattcgataatttcttatatatggatgaacaatttttgggtttaagcttttaattcctagaaattttatacattaaatctcctgcaatttgtcactctggatgttactgtttaaaaaaaaaaaaaaaaaactcgtag

SEQ ID NO: 249 - DNA, 572 bp, Homo sapiens
  misc_feature (106)..(106): n equals a,t,g, or c
  misc_feature (110)..(110): n equals a,t,g, or c
  misc_feature (422)..(422): n equals a,t,g, or c
  misc_feature (427)..(427): n equals a,t,g, or c
  misc_feature (548)..(548): n equals a,t,g, or c
ggcacgagccagggcccagcatcagaagccggccgttttgatagacgtgttccctctgcgtccttgcagccttccatctgtgctacctcccaggaagccgaagcgncagnagtccctttcggatggcactgggagcaggaaaatgaggtgattatgggctgctgctccaagaagtattggcagctgttgctgggggcggctccctggggtgtcatcccttkcttgctcttgtggatgggaaccagagcaccccacttcaaagactctgtaagccagggcttaccaragaaagctgaagagtctagggccaattttaatcagtttcttgtgcttctcatgccaaaagagatgattgtcctcactatagttcatcctatagtgcggcgggcctgactcgctactgccctctaatgttctggganagaanctgttgggtctttcctacctaatctggtagaaatgtgagaacagaggctaatttggggaaataaatctctcaatttttttgagttgctttgtgtgtgtgcgcgcgcgcatgtgtgtgtgtnaggggcagggtctctaagaaagaa

SEQ ID NO: 250 - DNA, 947 bp, Homo sapiens
  misc_feature (547)..(547): n equals a,t,g, or c
  misc_feature (555)..(555): n equals a,t,g, or c
tgaagacaagggtggcatatatttactttgcaataagtacaccatattgggtccttttgagattgtcatttgggtgtgtagcatttaagatttaacagctttctattatagagatcctacagctttatattagaagattattctgaagtcataacatttttttaaaaaagtaatttcagaaaaaaaaaagaatgttactgggataatgaggaatgatgtctagctgcctggtggtggtcatcactctgcgtgcttattttagttggttgcaggccattagaagtcaagttgtctggtcacgaatgaaacgtttacagtctgcttcaaggcaatcaggactatccattcccaggagtgaaatgtctgcattgcatagactgcaagattggagtgataaatcacacatacttttttttatttttttgccaagagtttgtaggttcccattataaagccaggcacttgatttagaatgtgtaaggcaatcctttgggaatgctttgggatycagcataactctttgaatgaactggagctttgtgaattncctttttntcctcagatcataaggtagaaaaaaattccttttaacaaaatagcattcttatccacccaccttctgatccaggggagtacactgggtattgacctcaggaaagagaacaagggagtgagggtacaggaaatgttaggagtgtgagcttgaagacaaagacgacccaactggcaaagacagcagttgtcaatcagagcagatgaatcatcacatcagcaaatattcattatatatctgctcaataataagaaaagcttctaccaaaggccaatgctccagacctctccccgaacctccagattcacttacccacctgcctaccccagcaatgtacagagcatcgcctcgtgccgaattcgatatcaagcttatcgataccgtcgacctcgag

SEQ ID NO: 251 - DNA, 1633 bp, Homo sapiens
ggcacgagcatcagtaagtaggagctagggaagagaaagcatgcaaaagggcaagaatcaggagaattgatatagtagctggacagaactctagatgtgtgtgtgtgagagaaagagaggcagggagaaggagggaggagttacccccacgatgacctccaacttccctttctgcaccctcatcctggggatagcacaggctcaggcctgccctggttgccctggcgattggcctggcctgggctcaggggtgggggaggggctgcaccacattaggacctgccgtactccaatcccatgcagtcctcctgctcctgctgctgcgtgcctgggctctggtcatgccaggcttccttgtgtcctgcgtctgtggccggttcctgccaacctgtctagtcctttcaggcttgaggccctgcattgctctttctggtcctctcccctccttcccgctccccatctagccttttttgggttccgggatctgctgacagactttcttcttgctgcctgcctgcttacatttcagaagacccctctggaactgcccatggctgtggtccacctgctggtagcaacgccctgttaccaaatgctagataatctgccactcccctctgcagccgccaactggtgctgagctgccacctgttgtctgtttccacacccttgtacactgcattctgcctgtcactctggacagctgcccagcagctgcagctgaggccgtcctgccagcacctaccgcagccccatgggtggtcctgtccagttcctggcgctcccagcctgcctcatctgctgtacttacagagccacatctggttgaatacagagctggggtagcctggatgggcccatggcacactcactcccagagaggcgggcatcctctctctggacctctagggaagggcagggtctggagcccaataataaaacacagtaatgataatcatagctaatgtttactgagaacttaggatgtgataggctcaatgatttaccagaattactctatactgcataactaccctatcaggtaagtactattaatatcccctttcccacatgaagaaactaaggctaaccaatagaaatgaacctgtgtaatgtcccatgggcataattcatggagccaggattcagaaccaggtgctttacttcagggctgaagctcataaccactagaccaaagcgcctcctccgtgacctctggggaaggcccagcaacatcctctattgcgtccaatgacttctccctggtctgagatccactgactcacaggggtagggttaaggttaaggccagagtctcagctaagctttggatactttcttctggatttggagaaggctggaataactgaatttctgctcatcttcaggagcggcctactagagccacacatttcccagctctccttgtgtgtttcccagacccttcttccatcgtgtcctctcccttaggctcctggaaagttttcagagagaatcacccagtggtaacattgttaaacaaaacaggaaaatgggacttgtgtgtatatatgattaaattattaattgatggatctaccttcttagctcgtgccgaattcgatatcaagcttatcgataccgtcgacctcga

SEQ ID NO: 252 - DNA, 1918 bp, Homo sapiens
gaattcggcacgaggtaggatgagagagaaagaagaataggagatggttaaggttggggcctggagagctgtacagatattgatgctattcgccaatccaggacatgcagaaggagcatgcatcagccccgggcccgcaggaaagagggagccactcaaactaggataatgcacagagggtgttttcacaaaggtgtgagcgtggtgtcggataaaggcaggactaatgcagtaacctagagccagtagcagtggagtgaaggagcttctcccatcacccagccagaagaccaggaggagaacagctacctggaccagaaggagaggtcttgtagagaagctcccttgagaggatccccttctgccaagggacagccaacctaggtggtcttgctgggagcatgacagaggagttaattccccggtttcatgttcctcctttcctccactcctctgagggttactagccaaatccaccgaaggcagccaccaagacatcctcacagatcagcctcccaggacacacagcagggcaaagaaggtggagatggatgggaggggagcaaggagcagatttggaggagtgcagcatggtcctaggagagcgccatccctgctgcccctagctgtgtggccttggccaggttacctaacttctctaatcctcagagagaggttggggctgaatactcaggagtcttcagtggaaaggtggatgccatgggtgtgctgcgatttcctggagaaggtgtagcttagaggggaactggggcaggctgaagagtgagagtcagggtacgaggctggggaggagccaccacacagtcagcagtagcttcctcctctgggatcctctagcattttctctttaacttctcacagaagactttacagattttattgccactgcttccgtgtgcctcccatcagagtgtgagcacctttgttcctcagtccctcaaggccgatgcatggtcagcccttgttagttgagtgaatgaacaaacaacactgaagaagctgcccttgaaaaaccggggcatcgttaagggctttgagcagaggatagaagacagtggagggggaggctcakgaggaagtgggatgtcaagctgtggggcagctgcaagaccttgcatgcatttggtggaaatttcytaggggctaccagggggcaggctgtgcttgggactagaggctagagaggtggggaaggctcagtctctgtgctcaagagacagccctctggacagagcacggcagctcctccatgacacagctgtccacaagcttcggagcacagctccttgttagtgagtggtggtgttaggcaggtggggaggtgggggaagttgaaaggtatcctggggatgagcaaagtctgatttgggggtgaaggggaacatgcaacaatgaacccagttcaatgtttagggcaaacgtttaatgcaggaagcagtgagaggtaagactggagccataagcaggcagaagctcgtggagacccaagtgcccagatgtggacttttccttataggcagtggagctccctgaagggttctgaagcagagaagagcatacatagtcaggtgtgcttcttacctggactactgctgagggatatttaggatgcagcatcctctggatggttgctataataataactattgtgacaaagcttcttcctgtggagctgttgtgtttgcaaatcggaccaaggtcccaggcatccaggccatggagctaagttcctagcccaggtctctggtcagggcataagtcattcagtgtgccaaacctctgaaaggtagcccggcccctttatttaccatactacacacagccagttcaccttctcctcctgagcacctgctcgtgccgaattcgatatcaagcttatcgataccgtcgacctcga

SEQ ID NO: 253 - DNA, 1026 bp, Homo sapiens
gtctaaatgttcagtttttcttcctaattccaatgattctcctcatttctcaatgtcctttgtccatctttgctgctccatttgcactgcctcccaaaggtcactgtggctccttctctgacttccacagtcaagttacacttcataaaaattctaagctcattttcagaagccacaaatctatccttctttaaagtcttcaaactttgattgtgtaaataaatactcagaaacaagatttctaaaaaacaaacactattggccatcgtatgttcaaaggagataacaaatgtttaaccttatatgttgtaggctttctaaacttaatttcaaaaaaagactaaataaacagtgtcaatatgtctataaactcacaacgaaaattttcagatcatccaattgtgtattcattggccggaaacaatcatgtaaaaaccacagccctggagctgggtagcatagaaacaagaagattcagcatttcatggttggtgactcaaatctctaaagggktgtcaggttaaaaaaaaaaaargaaaagaaaagaatagaaatttgacctgatctataaaaatgaaagtcgctgggcaaagttttggcttttcactcctgacaaagatgagctctctcataggtagaccaaggcacacgagtgatgactttcgtggccccaaaattcttcaagaaaatagtagattgaggaagcgatctgcgcattgatagaggtgctgtttgaactggatgacatttaagcttccttctttctccaagattctgtgaggccatgaagcatgctatttcatccccactccaattgctgtctccctggcctggtgcccttaccacctcaatcttgggtcactgatctcttttgcaagaaatcagtcctgcctaccacctgcaacttcatcttcctaaaatgtcactttccttaaggcctgctctgttcaaaggccagttcccagccacaccaatgtaaactcgtgccgaattcgatatcaagcttatcgataccgtcgacctcga

SEQ ID NO: 254 - DNA, 1757 bp, Homo sapiens
ggcacgaggtagatgggtttttggtgtggatgtcctttctgtttgttagttgtccttctaacagacaggaccctcagctgcaggtctgttggagtaccctgcaatgtgaggtgtcagtgtgcccctgctggagggtgcctcccagttaggctgctcgcgggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagtctcgctgccgccttgcagtttgatctcagactgctgtgctagcaatcagcgagactccgtggggtaggaccctctgagccaggtgggggatataatcttgtggtgcgccattttttaagcccgtcggaaaagcgcagtattcaggtgggagtgacccgattttcccgattttccaggtgccgtccgtcatccctttctttgattaggaaagggaactccctgaccccttgcgcttcccgagtgaggcaatgccttgcgctgctttggctcgtgcatggtgcgtgcacccactgacctgcgcccactgtctggcactccctagtgagatgaacccggtacctcagatggaaatgcagaaatcacccgtcttctgcgttgctcaggctgggagctgtagaccagagctgttcctattccgccatcttggctcctcccccaccccccgcccaatcctaagtttatctcttaacaaagtaaatactgcacacgtatttacatgttttaaaatattgtttatggagcacttactatgtgttttacggtccaagtactttatattattcactgactctttatagcaactctataacatattaatagattgtctcaatttcactgatgacaaaactggcagcttagtaactaatgagtaacaataccagcccctaaaacctagggtctttccactacagcacactctgactgacattgctcttgttcagacacagcactcttcacctagaaaaggatggagagctagaaagtggttttctttttcaagttgttcccattcatcaatattctatcaagatatatggaagagttattttctaggtcttccagaaggggctgctgacacttgggaattcaaaataattactccagagggaaatgtgggcatagaaactttttaaaaactgaattttcccgatctaatatcggcttccacatacagtatattatttcttaaaaatcagccagaaatgcacctgcagttttatctactggattttcctttcccagccccattcttctttaagtagttttttttccccattttataaaagaaaagcatacctcccacctatagcttccctccttatggtatattatctcaggggataatttgaaatattgcttgagacacaattctcattaagaaataaactttcaggctgggtgcagtggctcacacttgtaatcccagaactttgggaggccaaggcgggggaggatccctgaaggccaagagttcaagaccagcctggaatatataccaagatcccctctccacaaaaaaaaaaaaaaaaaaaa

SEQ ID NO: 255 - DNA, 752 bp, Homo sapiens
ggcacgaggggagaggcaggcatttgcattcagtcttgaaggctgaatagggcagggtaggcacagtgattccagagagaagtctttgctcctccatctatggaaaaacttctcacattgtatttattactatatgtttcttactggagtgtctctcctactggacagggagcaggtttatttattgctcagtcctcagcccctggacttaggcagactcatagtagacatttgggaaatgcttgggaaagaaaggaggggaggagagaggaaggactccatggccatgtctaaatgcccagcaatgtcatagaggttatgggggtgcaggagaagacacagccctccctctggcagctaggatagagcctagctgctgttaaagacaggcagctcattcctcacctgggccaagctgcagctggtcatctctgcccctttctccttccatcttatgggagcttttatggagtcagaagtgagtgaggcagacctgggagagccctacactcaggaagaatgtaggctgcagaaaggaacaggtgtcctggagttagctcaggaaggtcttgaaggaaggggttaacyagcagatggcaacccagtgacttttgttgctctctgaagccacagaggaaaacagtagcaacrrratraaataaaataaaataaaaaataataaaaaagcaaagttcccaaggaaataagatgggggaattcgatatcaagcttatcgataccgtcgacctcga

SEQ ID NO: 256 - DNA, 1602 bp, Homo sapiens
ggcacgagaaaacctgtggatttgagttgggatgacattattgatgattagctgagtgtggatttgagttgggatgacattattgatgattagctgggggagtttttgtcttcacagtgttttctccccatgtatgaatgtttcctgtctctgtctttactgaagtcttgtaaagctgtgagtggacttatgtgcctcctgctgccgaggcttggtctgctgctcctcctaccgagtgagcgatgcttctgctggattccggtgtactccctcattacctgccttgctgagtgctcagttgttctgcgggatccagggtttgcgggagctttccaggtacacaggcgccaggcctgcttctccaccctgcgctggtcctgcctgctgctctggtgggtgtcccgggtgagtgcaggccgccctctcataggcagccctcatatgatggctcccagcactttctgtcccaccgttaggggccctgggacctgtgcttccagcgacccagatgggtgaggctgtaacagcctgggccggctgcctctgccctttggtgaccgtgatggggaggtgtccacaaagcaccctatatgttggcttatcctcccgccaggtctgtagtctctacccggtcaccccttcttcctgggaccatgccccagatcagctgctaccctcaagctctaccattagggggcccaggcgtgttcagggaaggtcactgggtgccaccttctcccccatcatcacgctcactgctttctcttgatgggtaaggcttcccgaatgatgggaactaacagtggtggtgaagtcgaggcagacttcatcaggcatttagcatccaaggggtggctcatgagtgcagatacagtgcaggggccggagaggggctgggctgggctgacctgggaggctgaggctgatggagagtgggcaggtagggtggagaggcaggaaggttggtggcagccacatggctgagggctagagcctggccagggagtctggagagaggcagtgggtgggctgggggttcagcctgctgaaggggagcactggtcagtgcccataccccatggggtgaaggcctgggcagggcccaggggcagcttcgagggtgacctggagctgctcaggaagtgagatggcccagcctgacctgaccattggctggcaaggaacgggatggagaagttgtgtcctgggccttcagcgagtgtgacattgtcattgttgggatagctttaaagatctgattgcttatgacatgccttgtagcgctaccagcatcttggcatttggcaggtctagtccagctcgctgtttgcacgtcttctgtcttattcctagaagagagagttcccagcttgcttgatttccccccattgatgggaggctcatcactttatgggagactcattttacttaggccttctgaggatagtttcattctgatagtttttttttttttttttttttggagactgagtttccctctgtcgcccgggctggagtgcagttgtgtgatctcggctcactgcaagctccacctcccaggttcatgctcgtgccgaattcgatatcaagcttatcgatacc

SEQ ID NO: 257 - DNA, 1873 bp, Homo sapiens
ggcacgagctcaggctcccgtcggacttcacttggccacatccttcactactctccttccttatgctttatttaacacatttccacgagacatgtgttcccatgaccttcttccatgtccacctccacagttttgctcaggttctcgttccctctcccaggcctctctccactctatactttcaggaattctacccatgcaaagcccatctcagcttccacctcactcctgacttgacacctcctcatgcagcctgcctgcctggcgccttgtctagatgctctcacctcgttctgccttggattactaaaacttactttctgtcttgctttctttccttctggagttcttgagggggagtgcagcttctttacaatgtctagatccctgtcccatccacgcacactgcacagatacactacagagcgcccagctcacagcagacactaaatggtgaaagaatgcaagagggtcctgtgtctccctaagtccaaaaggagacataagaatattacaggccgatatttgtaacccattaagaaaaaaggtgaaatagtgtcaatacctaagcaaaataccatgagaatataaatcaaagtgtgaacaggagtaatattaagacagaaaggcaatggttctcttctggaaccattagcatttaaatacagaaaagaaaatgcaccattttaacagctgcagaagataataacagacacaattatttttccctaactagatgccatgccccatgtacagtagttcctaatcatcccctcatcttagtctcataacaaccctattattgtctctatgttacgtaggaggaaactgaggtaccgagcagttaattaaccttttccatcatgcaaccagcaaggcagagctaggatttgtatcccagtagcaccttttccagattcaagctcaactcctaaattctcctgcgtcttcactgtattgtttttacaacacatttgcaggttgtgggctaagtcaccggctactgagagataaagaagtaacactcctatgaattttacatttctggctgggcaccgcagctcacacctgtaatcccagcactttaggaagctgaggcaggagaattgtgtgagcccagaagtttgagaccagcctgggcaatatagccagaccccatctcaaaaacaattgtgcatttctaatactcactgagcccctgctatcccctggctcagtgtacattgctctatatctcctagcaaacccaggagctatgtatgaactgaaaccctggttaaatagcttggtcaaagtcacacagctcaggtgggggaggctgggtttaaaggcaggctgctgatgctatgatccatacttgaggctactgctggccacaggctccatctgaggccctgtagggggtgagaggagaaacccggccccagagacagggtctgaaccctctgctgccagccagtagagaaaacagtccctcacccacaacgtggggataacactgcctaccacaccaggcagtggaaagaattaaattaatttaaataaaggagacagtgcagagtacctgacacgcaataagcactcaatgagagctattattagaggtaactctccctgctttcagtctaatgccatgtttcttatcacttaaggtgatcaccttgttgctctttaaaatattatgtatggttttctctaagatacatgtaagtgtaaaatgcagaagaaaagcatgcggggacggggggggggaagaaattcccttttctttattgatcagcctttcccccaaaatactttctcaaggaattattaaatactcaacatggcgcctcgtgccgaattcgatatcaagcttatcgataccgtcgac

SEQ ID NO: 258 - DNA, 1384 bp, Homo sapiens
ggcacgagcagttattttcaaaatggctatggaaaacacgtaagttttaaaatatgccctctttctcgttttaaaaaattattactattgtccatacatgttactcttttcatctagatttatcatgtttctttggcctccagtctctggtgtttgcctaagctttattagagacaggtcatttctacctatgtgtcattttatctatgtcttgatcttatgtaattcaattgctctttaagattatgttctcttctcatgtttggtttatccattatccaaattttccatttctttaacctgttatcccttgactctttacagttctacctttttattcacttagtcttttaccctttttttattcgttcacccctttttgttgtttcaggtactccttacttatctccttagccttttcttcttcatcttctttcttacttttctcctacttctcattttacataatacttactttttgcttcagtcttcaaccattgtcaatcttgtttttccttatattccattttactttctgaactactctttaatctcctgttcaacactacctttccttcttttttatcccctcttatttacacggtgattacaacagtttggtatagtctgatttatctgattgtaaaattgatgagttggatgtaccaaaaatataaggaagctaaattcaaagaaggtaaaagatttgcttgtgtcacctagctggttaattttggcatatgcattgtttctctacatagtctatgtagtcaaacaggtttcatttagaaatcattccccataagaagggtttcaatttgatttgaacaggcagagatggaaaaaatttcctctctgataactactgctactgttgtataccagtagaaatataacagcagcacttaggttagaagaagctcattagctattcagaataaatttcatttttcttaatttttggtaatcatatctcagcctgttgaatttaacttaaactctgaaagaattttggttgccatttaatttttaggtttccttaatgatagggacctaataatttgttttaaaaaatttgtcttggctgggagcagtggctcatgcctgtaatcccagcactttaggaagccaacattggaggattgcatgagcccaggatttcgagaccagcctgggcaacacagtgaaacctcatctctacaaaaagttaaaaaattaaccaactgtggtgccacatgcctgtagtcccagctgcttgggaggatgaggtgagaggatttcttgagtccaggagtttgaggctgcagtgagctatgatcacactcctgctcttcagcctaggtgacacagcaggacactatctttgaaaaaaaaaaaaaaaaaa

SEQ ID NO: 259 - DNA, 941 bp, Homo sapiens
ggcacgagattttggcaagtgctgttatgtgaacaccaccatcacaatcaagatagtctatagttctagtaccccctgccctgaaacttgcttgttctgtttagtcagctcctctccccaccaccagcccttgtcaactgactcattttctgtctgtatagtttatatcatttccagaatgtcatataaatggaattctagagtatgtttcctttggagtcgcacctttcacttaatgcttctgagactcatctgtcttgttgcatatatcagtacagaagtcatttcttttattgctgagtagtaatctgtcatatggatgttccacagtttgtttatccatttatcactggtggggatacttgggktttcagttttcagtgattatgaagaaagctgctgtcaacatttgcaaacagtttgtgtgtccacattgtcktagtaaataactaggagtggaattgccgggttgtatggtaacagtatacttatctatgaaaaactgacagacttttctaaaataactgtaccattttacattcccaccaccagtgtatgaaagtcccagttccttaacttcactgacaattggtatgtcagggtttggtttcatttttattttgttgttaggatttcaaagggttatagcgggatttcattttggttttaatttacacttccctaatggccattgagcatctccactgctcgtttgctatccatttgcctattttcttttgtgaactatgttcaaatcttttgtccatttttttaaaacctggattgtttcttattgatttttgagagttctttatatgttctggatagatatctttgtcagttatgtgttttgcaaatattgtataccattatgtggcttgtgtttttattccattaacagtatttttcacacaagaaaaaaaaaaaaaaaaaaaaaaaaa

SEQ ID NO: 260 - DNA, 945 bp, Homo sapiens
  misc_feature (295)..(295): n equals a,t,g, or c
  misc_feature (875)..(875): n equals a,t,g, or c
  misc_feature (914)..(914): n equals a,t,g, or c
gaatggtgaaatattaagtgctttctcccccaggttcaggattatgacagctatgtccattcacctcttctgtacagcattgtcctgtggaagttctggccagtgcaataaggcaattaaaagaaataaaatatcaaacgattggaaagatgttaatgtgtcatcattcatagaaaacatgattcatagatatacatacacgaatgctttgaattcataagtagattcagccagttgctggatataaagtcaatatacaaaaactatttttatagacatgaaacacgcaatgagnaaaaaaatttaaccatttttagtagcatcaaaaaacccccatacctaggaatatgaatttgtagtactatttgggatatgttgatggatatttatcatttccagtttgggattattataaagaaaatagccctgaacatttgtaatatatgacttttggtgaatgtagcattcatttctgttgattacaaactcaggggtgaaattgttgagtcctaagggagctatagatgtattcaacttcagctgatatggctaaataaatttgcgaaaaagattgcatcaagttatgctcccatcagcaatatgagagttcctgtttttccacattgtcagcaacactttgtactgttactccttttaattttagccgatttggctgaaggtgtggtaatatctcattgtagtggccaggcgtggtgctcacgcctgtaatcccagcactgtgggaagccaaggtgggccgatcacgaggtcaggagatccagaccatcctggctaacatgatgaaaccctgttgcctgtagtcccaactacttgggaggctgaggcaggagaatggcatgaactcgggaggcggngcttgcagtgagcctccagcctgggcaacagagtgagantctctcaaaaaaaaaaaaaaaaaaactcgag

SEQ ID NO: 261 - DNA, 1538 bp, Homo sapiens
  misc_feature (112)..(112): n equals a,t,g, or c
  misc_feature (147)..(147): n equals a,t,g, or c
ccgggttcggctctgtgtcagcagccgggcggcgctcgggcgggacatggcagcctgtacagcccggcggcctggccgtgggcagccgctggtggtcccggtcgctgactgnggcccggtggccaaggccgctctgtgcgcggccgnagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtrtgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcasgyttggccaaaaaaaaaaaaaaaaaaaaaaaaaaaaaaaaaaaaaaaaaaaaaaaaaaaaaaactcga

SEQ ID NO: 262 - DNA, 663 bp, Homo sapiens
ggcacgagaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaaaaaaaaaaaaaaaaaaaaaaaaaaaaaaaaaaaaaaaaaa

SEQ ID NO: 263 - DNA, 1437 bp, Homo sapiens
cgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcaraggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtggaacaacagaggtaataaataaactctggacatcggttgaaccagtgtcaggggtcagactgcagatcccagtct

SEQ ID NO: 264 - DNA, 1816 bp, Homo sapiens
  misc_feature (504)..(504): n equals a,t,g, or c
  misc_feature (1405)..(1405): n equals a,t,g, or c
gcgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaagtgatatcaaatgggnctctcgctgggacacttacctgaccatgagtgacgtccagatccactggttttctatcattaactccgttgttgtggtcttcttcctgtcaggtatcctgagcatgattatcattcggaccctccggaaggacattgccaactacamcaaggaggatgacattgaagacaccatggaggagtctgggtggaagttggtgcacggcgacgtcttcaggccccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgktccttggtttcatcatcctggtggkatcctgktcacaaatcagcatcgtcatggtgkacttccarctgtgtgcagaggnattaccgytggtggtggagaaattycctagtctccgggggctctgcattcwacgtcctggtttatgccatctttwatttcgttaacaagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctacaaaaaaaaaaaaaaaaaaaacttctcggccgcaaggaa

SEQ ID NO: 265 - DNA, 776 bp, Homo sapiens
ggcacgagctgatttctatttttaggagctacttggatttgtatgtattttttctacgtgaaaatatatgtactcttcacttttgttccagtactataattgctcatgcactctttctcccctttgagaacattcagtgaaatacaacttcatcaaagatttgctcaaaggagaagaatcgcatgagtgtgaaaagtagatgctcgtagccagaacagaaaaggttacacatgatcatggcacagaagataggaggtttgacttggtgggccataatgtttattatcctttttgaaataacagggaccagcagcagttttctcaggataaatgctctaccccacttctctatgaacaggtgtggggaggcttactttccattttcatatttatacacctctctacaaaagcaatttttaatgaaggttagtggaattgttaaaaatctgagagggaatgatgactggaggtgttttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaagtgagcaaataaaaaacatgttgaaattgtaaaaaaaaaaaaaaaaaaaaaa

SEQ ID NO: 266 - DNA, 406 bp, Homo sapiens
aggttttccagaaagttatcagatcttgctttcctgattagcagcagttagcggggtggataaaagcaccccttcagagcaatctcatttccatttctttcaggccacttattttttccaactttttttccgtatcttcataaatgtttcactcttctttgttagtatttcttagtctcttgagtcaagaaatatttactgagtatgattgcatgcataagtagtgtgcgttagagatacgatacctgtaagacaccacagtgctgggtagatccgggtgccattgtctgttgccagggccgaagttggcattttgtaagtgttcgaataagcaccatgccgtgggataagaaataaaagtgtgtgcctcatctgtaaaaaaaaaaaaaaaaaactcgaggggggg

SEQ ID NO: 267 - DNA, 1495 bp, Homo sapiens
cccccgggctgcaggaattcggcacgagctgacatatatttgagaaactgggctactgaaagccctaaccccacttggctgcattttatttggtaaccagtgaggcaaacacccttgccagacccctaccatccatcttgatgtggttcctgcactggacactgcttgggtacgggcctgcccagatcttgggaatgtgggcagtggctcctctgaagcaccagtgggcagaggatgagtcatggtatcctcccggcacccctccctctgccttgcattttacttgtgatccaggtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgaccaccttttacctgacacctgagccagtggtggcccccaacagcccaatctggtactcagtccagcctatcagcagagagcagatgggacaaatgctgacgcggatcctggtgataagagaaattcaggaggccatcgcagtggccagtgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaaaaaaaaaaaaaaaaaactcga

SEQ ID NO: 268 - DNA, 2895 bp, Homo sapiens
cgacccacgcgtccgctttcttctatttcttgtggatattatggctaataacacagcaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaattttttttgaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggtccatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagggaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttttttacttgcatgtcatccttaatgtctaacatgaaaaatcaccaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtaaaaaaaaaaaaaaaaaaaaaaaaaaa

SEQ ID NO: 269 - DNA, 2150 bp, Homo sapiens
  misc_feature (874)..(874): n equals a,t,g, or c
  misc_feature (1198)..(1198): n equals a,t,g, or c
  misc_feature (1201)..(1201): n equals a,t,g, or c
  misc_feature (1266)..(1266): n equals a,t,g, or c
ccacgcgtccggacccgagctccagtagttccgcccgctggtcatcgcgccctttcccctgccggtgtcctgctcgccgtccccgccatgctgtctctagactttttggacgatgtgcggcggatgaacaagcggcaggtgagcttgtccgtcctctttttctcctggctcttcttgtcccttcgaggctgctgctgcggggcccggcggaccccagggttctggtgtgagggtctgagctggtctgatacccgggtcattcgctttctttggagactgtggccagaggccgccttgtccgcctcattatttttaaccccgaactgattcagggcctacctggggcggggcgggaagcggtgtcttcacgttccattcctcccactgaggcaggggagcaaatggaaaccgtacgcgcttgaagtgggagttggggtgcttattgttttagtcattttaatgcggcggactcttgatttctccagtcggagcgactccaggtggtttcgggagagacgaggtttagccggtttctggggcgctcaggaaggcgattggaggccccacaaaaaccgttttgctgctttcagctccttgcaaccctttagtagagctgaaccgtagcgggctgcaccgactttgacttggaccactctgggctccgagttggaacagttacactacttgcccttgcgtccgcttagcactaaggcggcagccctcggaatctatggttttacagtccaatatcagtgccacggggatctggaaatgtaggtctcctgattttgtccttacactttactttgatcttctagatcgtatgccaaatagtactgagaatattgttgtaattatttagtccttagaaaangttgttctgttttatcttttgcgcctagtgtgtctgtagagcctagttttgctgcatcggactttttttttgttttaaacagtattttactgttatgattatcctgatgtcaccattaaggattttttttttccttggacttgcattttttgtacttataactgccacttagggaagtagatacacaacctttccttactccccttcaggccttagctagctcagtgtcaattctgtcagtcagaattgagcattctataaaaattgcgcaaacgttactttatgtctttatgacaacacttcaaatttttacttgtatagtgntgnctttttttaatccatatttggatttctagatgccacagatatttctctgaggaaagtatttattntgagtctgatatttattgactctatgctaggtccaatgagagaaatgcaaagatagttaagaaagactcggccttcaaggagcctaaatgtgtagaaaaggactaaggcaaaacaataacttttttgagctcttgccatgtgtgaagcactttatacacctgtaaggtaggtaacgttgttcttattaaacatgaagaaaatgagactttgtgagaagcaatacagtatagaagttaagaatatggactctaaagctagatttcagaggtttgaagtagctctgctacttactggctgtgtgactttgagcagattacttaacctgtctgtgcctatgtttacttttattgttgtaaaaagatatgcaacataaaatattccatttcaaccgtttttacgtgtatacttcactgacattagttgcattcactatgttgtgcaaacgtagggtcgctatgaagattaaatgagttaattcatataaagccctcagaagagtgtctggcacatggtgagtattggctgtactgtggtcgatgtcattgttagagagctttagtgatttgcttaagacagaaggtagactgggtgcgggtggctcacgcctgtaatcccagcactttgggaggctgaggcaggcggatcacaatgtcaagagattgagaccatcctggccagcatggtgaggccccctctctactaaaaatacagatactagctgggcctgttggcgcacgcctgtagttccagctactcaggaggctgaggcgggggaatcgcctgggaggtggagattgcagtgagctgagatcgtgccaccgcactccagcctggtgacagagtgagactccgtctcaaaaaaaaaaaaaaaaaaaaaaaaaaa

SEQ ID NO: 270 - DNA, 1827 bp, Homo sapiens
caaactgcacgacatcgacggcgtacctcacctcatcctcatcgcctcccgagacatcgaggctggggaggagctcctgtatgactatggggaccgcagcaaggcttccattgaagcccacccgtggctgaagcattaaccggtgggccccgtgcctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagtgccgcttttctgggcaccttgaagcatcagggcgtgaaatcaaactagatgtgggcagggagagkgttgcttacctgcctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgctttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaacaaggaaataaacttgaaaattatttgtcatcataaaaatgaaacaaattaaaatatttattgccaggcaaaaaaaaaaaaaaaaaaaaaaaaaaaaaaaaaaaaaaaaaa

SEQ ID NO: 271 - DNA, 3102 bp, Homo sapiens
  misc_feature (3096)..(3096): n equals a,t,g, or c
tcgacccacgcgtccgcccacgcgtccggcccagtagtttttattgttgggtttttgaaaaaacctctaccaagaatatggtgttttttttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctcksscctcctcccactctcttcccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtargttttgatttttctcaatttaagatacagaaatacagcaagccttaatataaagtttcctaaagtttcttcaagtattttttaaggtggagaaatgcaggaattgtataaccagaattgtttctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggttttyccaaagatgttctagatctatttggttgctctatagtcaaacagctcttttgaagacaactgtcttattttattacaaattggcttgacatatyyatactgtaacattgtaatattgctgtgctgtacattttggcccttackaaatacgtctttttcagaactgttaaagttttgatgtacatcragctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacaaaaaaaaaaaaaaaaaaaaaaanaaaaaa

SEQ ID NO: 272 - DNA, 865 bp, Homo sapiens
gctgaatataaggaaatatgtctaatggacaccagttaatactttttaaaactactctttaaaaaaaaaatacgttccccttggttaactgattttttaatccagggtggacattttttcaacctttattaaaaagacaaataaactattttgtagaagatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgaaaaaaaaaaaaaaaaaaaaaaaaaaaaaaaaaaagggcggcc

SEQ ID NO: 273 - DNA, 2612 bp, Homo sapiens
ccacgcgtccgcccacgcgtccgctccccagtagctgggatgaccggcactcgccaccaagcctagctaattttttttgtattttgactagagatggggtttcaccatgttagtcaagctgctcttgttttgttgttgttgttgttgttgttgttgttgtttgatactgagtctcgctccagcctggcgacagagcgagactccatctcaaaaaaaaaaaacaaaaaaaccaaaaaaaaaaacagaaaagaaacaaaaaacgttgttttaattttaattaactcaaatagcttcatgtggctagctgccgccctgtagaacagcacagttctagaactttcgagaccttctccctgttatccacacttactttacagagtagactcagcacttcgagtcccctgtccttcaggccaggccaaatcttggtccccagagcccagtgtggcagaggccatcgaaaactgacccacgcactctagcccagccctggatttacagccaagcgctgtatagggatgggtgactcttttgtttttgtttttgttttgagttgggtctctcgctctctcacccaggctggagtgcagtggcataatcatggctcgctgtagccttgacctcctgggctcgggccatcctcctgcctcagcctcctgcagaactggggctgcgggcacatgccaccacacccagctattttttattttatttttttgtagagtcagggtctcactgtgttgcccagactggtcttgaactcctggcctcaagctatcttcctgcctcggcctcccaaagtgctgggattacaggtgtgagccactgtgcctggcctcttggtgactctttgcaagggcattgctggctggctgatatggcctgcagcctctgcctgtaaccatcagagcgatactctcattatcggcaaggtgggaccccccctggcccaagagacagggcctgttattccactgtatggaggagaagctgaggcttagggaaggcagatgacttggcaaggtcataaagacagcaagctgcaggaccagctcattctaaggcatgaaccccctgtggcccacctcaccatgatgttaacatttcagcctgctccattccaggcagacagtcttccagaaagttacccggctccctggctgggcgcagtggctcgcgcctgtaatctcagcactttgggaggccgagacgggtggatcacgaggtcaggagatcgagaccatcctggctaacacggtgaaaccccgtctctactaaaaatatagaaaattggctgggcgtggtggcgggcatctgcagtcccagctactcaggaggctgaaacaggagaatggcgtggacctgggaggcagagctcgcagtgagccaagatcgcgccactgcactgcagcctgcacgacagagcgagactccgtctcaaaaaaaaccaaaagttacccagcaacccaagtcatatcctgatgatatccatactcctcagtcatgcatcccgtggtgcaggggctgaccccaagaggagctgctgcccccagagggtggggagccgaggcagggccttggtcagacttaccaggctatgctcccagcccagccctcactagggacccccgagtgcatctctctcctctccaggcctctgtttctccatctgtgcaaccacagtgttggacatggtagtcccaagtgtctgctcgtaactttgccctctctgtgcccccaggtcagggctgcgataagacccggtcacgggtgaccctgcaggagtggaatgaccctcttgaccgtgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 274 - DNA, 1237 bp, Homo sapiens
atgggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtgaagaaaaaaaaaaaaaaa

SEQ ID NO: 275 - DNA, 1899 bp, Homo sapiens
  misc_feature (1439)..(1439): n equals a,t,g, or c
ccacgcgtccgcccacgcgtccgcccacgcgtccgttacgatttataaaagcaaacttttaatttttcataatatatctattcctacctaggtttttttaatcaaattaataaaatggtactcccttttgtgttattgttcagaccaaattttatcagtgtccttcaccctttattctactcacattgtttatttctatacttaataagtcctgttcactcttcctctataatatattacaaacctgatcattgtcactacaccccattcattcctggtctactacaatagccaggtctacctactttcctttcggcatttggacaatctgtgtttctggaagtagcccaaatgatctttttttgttcttatattattcagatcctattactccttgatctcaacccctacaagatattcctattatatgcttaataaaatccaatatccctaccttggcctgtatactcaataaagtccaatatccctaccttggcctacaagatcttagatgactgggatctaggaaacctattcagctaatttcctgcaattctctatgtttacctgctcaaggtttttaccactcctcaaatattcaaactggttttgcatctttttagttctatctattcttttgcagatgccaatcttagtaatcataagcagtttacctctaaattaatgctaaatattgtaaaaggtgtattataagttcagtctttcatttattctttcaaccaccaagtgtcgattgaacacatacattgggtcacaccaatcaaataagatagactcccaggcatcaccgagcatctactactcaattcatctcaggatctatacaaggggtcattttatcagaaaccaaagtcttgatgctgtccgaaaaatcacgttttcaccatgatctcctacttccctaggtggaagtataactttttaggatatatcatggttgctgacttaacttttgtattttttaaatatactcatgacaagtatcatataaaacctaaccagcaactttgcaccagcaaaagtttttcaacatttcaattcttacaaaatcaaatgatataatttcctatgtagtaaaaaattcacacatctgcaaagcttggtttcactaccacctgttaaaatcttacctttggaagctatttatgattgaaaaacactttacctcactcacaaagagctggaagtctctcttcaatccaatatgcacacagaagacaaaaagctgtatcattccttgatgatatatttgaaatcatatggccacgtctgtccattgtcttcagagtttctaagtatttcagaaaattatgacttgcactgtagaactattttaaagaaattccatggtgcaaacagaaaaactaaaacttttcatgttaggataatttattaaaaatacaaacaaatcctatgtntacataagaagatagtaactagcctttttgagagggaaatttttctctcataacttcttttctagtaatttcaataaagaataactgccattccaacgtttagcccatctcactctcttgtcttcttatggccaagtattcaagcttgaaatttgcagaggaaattcttgtccgttttttatatcatgtggtaagcctaataaaacatcttctgaaataattagcccttaaaaggatagtatcttctacctgacagaggcaaatattattgaaaagtttgtaccttataagcacattaatcatggagtcctggaactggattctgtctaagactgacttttgcttaattaagttcacagagattttccacatatttttccagaacattgcatgtagagatattgtcgatcaatcacataactagggtcagaaagatgtaacaagggagaaaaaaaaaaaa

SEQ ID NO: 276 - DNA, 1155 bp, Homo sapiens
ccgggtcgacccacgcgtccggtgagtgcactctaggatgttcacatgatgacaaaatcacctaacaatgtagacgcttcagaacatataccctttgttaatcgatgcatcactgtatatatgtgtgtatatacacacatatatgtacatatatttaatacatttgtgtatgtgtgtgtatatatatatatatatacttctcattatttatactctagacccagagcctcctagctggtctccaaaattggactctcatctctctttgagacagccttcaaatgatcgtttttaaagtgctaattaactcctcttctcaaaatgcttcaatggcccactaatctctaccgaatcaaggaattcagccatactgtcccaagatatctttccttggccagttggagcctcatttcagctgctctgggtttatcccctgtctcttctttcccacttccaagcctgtgctcagcccacctcctcttctggggatgccccacaccccactctgccatatctgccaaacctttcatctccccgtgaagctcttgacaccaaatacagtttactttagaaaatgtattttttccactttctcaactaaacttttccttgtgtgatctgcttttccgctgccaaggcacatcgtttttaattctctacagcactgctcatatcttgcccagtattatagcttctacatattggtcttgcttcttatttttgagcacaaaaactaagccactccactttctcttaccagtgaatccagcttaaaaaaactgtgagcaacctatcagtattttgttgacatgaactctatagaaaccttagtccctggatcttcgactctgcctcccctgacatttatctgctcccacaaagcacgcaggtgtgggaagagaagtggctgttttttgaggtcacatttcagccctgattcatcctaatgtcttcaccctttttatcctttggscactgtgtycctagagatgtgaattcaattccgcaccattctctcctttacaatgatgccaatattctcaggcttttaagactaaattttaaattacgagaaaatttgatcttcaaacttaagttggacctagaaagaacaatctcatgaactcaaaaaaaaaaaaaaaaaaaaaaaaaaaa

SEQ ID NO: 277 - DNA, 238 bp, Homo sapiens
ccacgcgtccgctgcccccatgcagtggtagtcaccgttctgtcccccgcgggtgctggtgagaaaggtaaaagggcggttccagagcctgagggcctgtgagtgcagtttacataactgccgaaacttaaggaagcgtctaaataaaaagaaacatgttaacccaaaatggtttatttgtttttttttttttttttggtttccagagctcatgcaaacatgcaaaaaaaaaaaaaaa

SEQ ID NO: 278 - DNA, 1459 bp, Homo sapiens
acgcgtccggcgtctgcagctgcaggggaggaggactgggtccttccctctgaagttgaagtgttggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcctatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgccccggcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccgaagggaggggagtgccacgcccctaaaggtacccgtgacacccaggaactgccacctcctgaggggcccctcaaggagcccatggacctaaagccagaaccccatagccaaggagttgaaggcccccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttcaaaaaaaaaaaaaaaaaa

SEQ ID NO: 279 - DNA, 532 bp, Homo sapiens
actcatataagaaagcagtacgccgcagtaccggtccgaattccgggtcgacccacgcgtccgcccacgcgtccgcacctcccttggctgtggggaggggcttccatgccctgtgtggctctcgggtgggctgtcgcaccacactgctcttcctttctcttcacgaatcacgcaagcctcctagtcagttctgatgagataacctggatatcttggttgccggtgaaggatttacatgcttattatggtttttttgttgttgttgttgtttggttttttttttgatgggagcctcagatcgccgctgttgctaatcatccatcttggccctgcccccacatttctgcaaatttaaatatgagatttgtccccttaggtgcacagtccagaccccatccagtccagctccttttaaagccacatggaaagtcagctgagaatggtttgggagcccaggtgcgctgtcttccgccctgccctctccctgaaataaagaacagcttgacagaaaaaaaaaaaaaaaagggcggcc

SEQ ID NO: 280 - DNA, 1084 bp, Homo sapiens
agaagacgacagaaggggagccgctggggccgcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccrcacatgacaatggaccaaatgtgccacacgctcgctcttttttacacccagtgcctctgactctgtccccatgggctggtctccaaagctctttccattgcccagggagggaaggttctgagcaataaagtttcttagatcaatcaaaaaaaaaaaaaaaaaaaaaaaaaaaaaaaaaaaaaaaaaaaaaaaaaactcga

SEQ ID NO: 281 - DNA, 870 bp, Homo sapiens
  misc_feature (743)..(743): n equals a,t,g, or c
ggcacgagcagatattaaatctcacagaaaggtgttccttattaatctttacaaaattgtcatttccccggtgaagccaatttacattaaaaataatgttcagaaaatgctgctgcctgctttctctcctcttttacccaccccttgttctcccagcaatcttcgccctgtatgtttatgtggacaatttctattgtaacattctccattccattaactctgcctcttcctctgaggggggaaaataaaaccctaaatggctctaatagttatgtattttattttgtctcagaggtttccaaacttctgcttttagcttccttttcactgggacaaatggatgtaagttattttccagtttcctgaaaaataatcagggactattttcttcatctatctcaggtgcttcatgagtttcctaagatattaattacggtttccatacattcagaatcaagggactcacggatatggtactgtgttcactgctacacagagtttttctagaaaaaaaaattctttatttttatcttctatttgtatccaaacgatggtaaaacaaaattcctctttagctaggtactgggattttttctttaggaaatactaatagagttacaaaggttagcttataggtagacaaaagactggcggccaaacagagcagtgggtgaaatgggtccctgggtgacatgtcagatctttgtacgtaattaaaaatattgtggcaggattaatagcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactc

SEQ ID NO: 282 - DNA, 2263 bp, Homo sapiens
  misc_feature (1586)..(1586): n equals a,t,g, or c
  misc_feature (2262)..(2262): n equals a,t,g, or c
aattcggcagagcagcagcgtccggcgagatgaaggcgctyggggctgtcctgcttgccctcttgctgtgcgggcggccagggagagggcagacacagcaggaggaagaggaagaggacgaggaccacgggccagatgactacgacgaggaagatgaggatgaggtkgaagaggaggagaccaacaggctccctggtggcaggagcagagtgctgctgcggtgctacacctgcaagtccctgcccagggacgagcgctgcaacctgacgcagaactgctcacatggccagacctgcacaaccctcattgcccacgggaacaccgagtcaggcctcctgaccacccactccacgtggtgcacagacagctgccagccyatcaccaagacggtggaggggacccaggtgaccatgacctgctgccagtccagcctgtgcaatgtcccaccctggcaaagctcccgagtccaggacccaacaggcaagggggcaggcggcccccggggcagctccgaaactgtgggcgcagccctcctgctcaacctccttgccggccttggagcaatgggggccaggagaccctgacccacggcccctccccacccccacccggctcacccccggccctgccagcactctgtctggtaccttcccctcctgcccctgcaccagctttggagaatggatttggagtgtcttgggcgatccagccagcgcaggccccccggcccggttgcttcctcagttcccggctgtgtccttggtgtcctttctccaccacctgtgagcagcaagactgccgcacgtgggcgctgggtccagacctcggctgccacgycccaggacctgyagccctcacgggggctggggatccccatcagcacagccaggcagagatgatacccaccacacacctgggggcccccacacccagtcctcacccttaacttctgccatgggaatttctccatctgcagcagtcacacgggcccaccctgcccttccccaggtcggcctctccgctgtctggagggaaggggatttggagggaggctgtcgtcgcccccaggaaagacgggcctgggggaggcgggacagtgggagaggcgcgctgaggatgagagggcacagggaggtgggttggggtgaggccacatgcggaggggcggggcggggcggggctggggggacaggcaccaagtatgaagaggatggggccagcggggcctgtctggctatggcgtgagcaccgctatgggagaccctggcttggaaagtgaacttgcagccttggatggggaagggccagatgctgggtgggtgcctgtcaccttgaggtgaccatctagggtcagtacctgctgggcttaggacagcgcctgaggctgggaatacctgtctctgctctagcagaggctaaagcaggctagagcagtggaggggtggagttgatgaaaggagaggagtagatgagatggaatttttccagcctcatcctggcctgccctctagactccagtccccaagccctcagcctagtgggtgtcatggatggatctgggggtgtcagacaggcttaccctgtgnccagggagggggcagaatgggcctgcagcttcctgcaraggaagcaggactgggtagcagagccgggaaggtgggtggcccattacaggggggtccccagggtgtcctctggcagggctgtgactgctgcaagctctgccttcaccagtagctggtgccaggacagagctctgggacagcaggcagaggccgagcctgggccacagctcagccactgacttgggtatcagtttccccttctgagaagtacagagtgagacttaaagaacccctagatccccaccagttcaacactccattaactgggaagcccagagtcctgtccggcctgccaagttcatcctggtggacagcgggaggcctccgctaactgttctcttcttttccttattaataaaacacacaatgcctagctggggggtcggaaggcaaatgccctagatggtggggtcacgtctttctccttctccttcctccttctgctggctgaagtgatgactggagctcagcaaccactttgcaccatgaggcagcactgagcacggtagggcagcctggtgagaggggcctagctcgctgccgacagaagtcactgcctacctcagggtccccttacctgggtgggaaataaatttctgctgtgttgaaaaaaaaaaaaaaaaaaaaaaaaaaaaanc

SEQ ID NO: 283 - DNA, 2566 bp, Homo sapiens
  misc_feature (2553)..(2553): n equals a,t,g, or c
gcaaatagcaacttcagtacatcataatataaatagaaaaaaaagatcagtgcttagattgttaatgttttgtttttatttgaattattttactaacttgtttttgtttttaacctgttctcgctcagagtccctctcctccccgacaggaccctattcaggtttccccttcttaaagtctcccccagtgaggaactctctcaacaagggcccactcctggtgcagtactatagcttttcatcccacctcagagtcccccgcaaaaagaaacaagtgatcagagtaccagtcagggtacctcctaaaagcccagcgatgtcccctccatccagtccaaggtttcactttttcaccttttctggtcctttccccaacagctattaatggtattatccattcaggtctttcttcaccccaggccttgtgggaccamccttaatcatccagtggtactgccccctcttaggatataccaccamcgstcacacaggatctccacccagaaacaatgacatctggggtctttctccagtcccctggcatggtatttcttacaaactttctacctcccactggctaatagctttattcaagtasaattacacgccataaaatttactcattttatttttttatttttattaagttaggttgtgttcaggatttactctttttaagtctgcaattcactttttttttggtaaatttagagttgtacagtcatcaccatcatccaattttagcacatttccatcacctcaaaaagatccctcatgcccatttgstgctattccacattataaccttccacccctggcaaccactaatctactttgtgtctgtatarattggctttttctgcatatttcatataaaaatggaacatataatatttggtcttaagtatttttgaaacatataattttgttgtggaaatagtagttgattttatctatgtctttatcaggcctttctctgtattgaattttcacattgtcaataccactcagaaacagtggttyatcctactgcagcaagttcattgaatactgttggcactggaatttatccctgctgtaaccaaaaggtyctycggtttgatcctactcagcttacaaagggctgtaaartgagggaccacatggttacmcttcgtgatcaaggtgaaggsggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacmaccaaaaaagcaggtatcttcaccctgtgcccagaggaaagaaaaggcattggagaaggtaactctgaattatctgktgktaaagtcatatggaaaaataagcatgtgagtatagccagaaaaaaataaaaagagtaatgaagacacatggaatgctagcaatgtaaaaatgaagttttttatagactgagattaaagatctctaagatatattgacaaatgagaaaaggaaggtgcagaaacgtatagtggtatagtatgctaccatttgtgtaaagtagatgggggaaatatataaataacttccttgtatatgcataaaatgtttctggaaggctacataagaactcgataaaattggttgcctctcaggaagggaactgaacgtgtaagggacagaagtgagagtcttttcattatatgtgccattataccttttgaattttaaaccaatattatttattcaaaaaattaaaaatagtcttttaaattaaaaataaatcatattttatgatatttaaaaataattcttatttctccatgcctttgaaggaaggggtaaaaaagccaggtaggaataagagaatagtaataaccaccattggctaaaagaaaaactgtgaatttcaaaaatgtgtgataggttgagtctgggttaagatccacagaattacattggacacattgtacattcatctttgtgttaagtagcacaggcatataagtgggttaattctaaaaaaaaattgtatcagctggtcttgagcttttgacctcgtgatctgcccgcctcagcctcctaaagtactgggattataggcgtgagccacaatgcctggccacatttatgtatttttttatattctgtatcagttagcctgtttattcacgtaaaagttttccaccatgtcttattatccatggtccataggtcatctataacacatataataaagtacatcattgctgaaaaaaaaaaaaaaaaaactcgagggggggtcccgtacccaattctcctnacatgcatcgtat

SEQ ID NO: 284 - DNA, 1835 bp, Homo sapiens
ggcacgagagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgaaaaaaaaaaaaaaaaaaaaa

SEQ ID NO: 285 - DNA, 661 bp, Homo sapiens
gaattcggcacgaggggaaaaggatgctgaacgagagcagaaagcctctttcctttgcttcacgcctttccagtctttattttaaactcgggttccctttctgtggtcgcagcaacctttactccacctgcactgctgctcctgggggctccccaggcctccctctgcctttctacccagtggctgacgggatgcctgtcttgcctggacgcaccactgctctcctgtccctcaccttggcttttgctgtgccctgctctggggttgaagctggcccatgtgtcccccggagtcatggctgctcctcctgggaggcctctgtgtgcgtcacgtcttccacacctgggggcagctggcgagcccgtgctctgttcccctcggctgcttggcacagagytgcagcctgggaytctccgtggacccagactggggattttgccaggggggcgatgggaggagcaggtgctttgcctggcggctgtgtctgcatttctggacgccccagagcacagaagttgccggcactttgaggtcttcctcggcatgtgccagattacatgagtgacggctgggaatatgttttcttttttgtaatggaggcgtgtttcacatatagtaaagctcaccaaaaagtaaaaaaaaaaaaaaaaaaaaaactcga

SEQ ID NO: 286 - DNA, 1378 bp, Homo sapiens
agacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggycctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaaaaaaaaaaaaaaaacttcgagggggggcccggtacccaat

SEQ ID NO: 287 - DNA, 1366 bp, Homo sapiens
ggcacgaggttttcagcggtattattatttgtgagtctaacctagcgggtggtcctggctgtcaccggtgcttgggcgggatcaccaccagcggctgcccgtacttgggccgccacatgaggacctgggcatcgttggcattgggcttgaccagggcgctgggcgggatgggctcattcttgctcaggattttgggctggtcctgggcgatgggctcccgcagccgggcgcgctggcccaggggccggttggggttcacctcgatgctgagctgcatgcgccagtgcagcgtctgcaggatgatcatgtcgttggtggaggtgttggtggccaccagccaggtggtgaagctctggtcccggtagatgttggtgagcttggccacgttgctctcgctgacgggcacggcccatgtgacgctggggtaaaagttgtcattcatgctgatgatgaacttggagtccctcttggtggggcccacgatggtgcaggtctctgtggtgttgccgtaccaggggtagttcaccccgtccgagtcgctgatggcttggatcttgccctcctggaggtcggggagctcccagctggacatgccctgctcgccgtactggttgtagaactccatgtggctgcacgcctggatccagccaactacccaagtctccttcttggggatgggcggcatgaccacctgggccgaggcccggaagtggggtgtccggtagcggagcaccacgctggaggactcatcgatgctagtggggacggggtcgatggaggctttcacatcaatcaccgtgatcccttcccggaagactctggctttgcctccgatgctctgaatacagcccatggcatacaggagcgctctgatctccagggaaggccagcagtcacagaaaaaaccaggcattgaaaggacagaggctgcaggacccagtacagacggcgctgctctccaatctcaactctcaagaccgatatccataggatagaaaactcactgagtagactggggttgcatatatcactaccgcggcctgtttataaataaggattctgctgcatttcatgagccctgggctctctcttcttctcctcgcagtggacaaaaatcaccgatattctttgggttaaaaaaagtttgtagtttaatgaataattatgcggttctgacatccagcccttctgtgcctcacacgcggggacggcagctcgcagactctccctgaagtcttcggaggaagcaggcgagcgccggcagactcataaataaggaaggctctgtccccgcgcggccgcgccaccctcgcggcagaagcctgacttcctgccctccggccttccgcacgcgctcccggcacga

SEQ ID NO: 288 - DNA, 715 bp, Homo sapiens
ggcacgagctttccctcagtccaatcttgcaattgctatgtcagtttcagttcacaataataccagtgcagacatggctccttaagattttctccttttccctcacgcgggtcccaattctaaattcccaagggctgacatgattgacatttgccatagcctgaggagggagcatttccttttgtggtctttccttggtttgttttattgggcagtgaatggcaagtctgtctgtgtttctttgcttcaccccaaacaccttggcaaaaatgaaagccttctaatttagctgtgtcctcctttacttatgtcaggaagcctgagccataacctttgattaaaaaaatttttttttgttttttgtttttgagacagggtcttgctctgtcacccaggctgaaatgcagtggcacgactgcagctcattgcagccttgacctcactggagtgtagtggcatgactgcagctcactgcagtcccaagtagctggcacttacaggcaggtgccaccatgcctggctaatttttaaattttttgtagaaacagggtcttgctggctgggcacggtggctcacacctgtaatcccagcactttgggaggccaaagcgggcggatcacgaggtcaggagtttgagaccagcctggccaacatggtgaaatcctgtttccactaaaaataccaaaaaaaaaaaaaaaaaaaaaaaaactcgta

SEQ ID NO: 289 - DNA, 407 bp, Homo sapiens
  misc_feature (352)..(352): n equals a,t,g, or c
  misc_feature (376)..(376): n equals a,t,g, or c
  misc_feature (378)..(378): n equals a,t,g, or c
ctttctgggtttagggaagtggtggacaaggcaggagagaaccacattcatcttctcctcttgtgtttgtcttctgtctttcaataacgtccatgaactgtgaggttagtgtcttggctgagagataagtawggctkggcatkgattcttytgtkgtwacctcaagctgttttctagtccccaagaacagcaytytcagtgggtgtggaagtgggcgggacatgaagcaatggttttacattgcattgcctggctacagsttggcatttctttcctttttctttttctttgcgtcattgccattggtgccactaattttgcttcccctytcttttataaacttgtttcctcnggagttgcctaagagtcctgcatnanaacctaattgggaatgaagcagtgtgttc

SEQ ID NO: 290 - DNA, 711 bp, Homo sapiens
ggcacgagcgaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgkkactctggaaatatgaaggaactagggagtggaagagatttcagagctggggagaggagttcctcccttcaaagccagcaactgcctttggggaatgtcggggggtctctcctttctcctgcttgtgtkargtggtacacagtccccccttcacctggcgggaagctgtcccggacagactcatctcagctttcccttggggcaggatcgggggcagcagctccagcagaaacagcaggatctggagcaggaaggcctcgaggccacacaggggctgctggccggcgagtgggccccacccctctggragctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttcaaaaaaaaaaaaaaaaaact

SEQ ID NO: 291 - DNA, 875 bp, Homo sapiens
ggcacgagtgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccascctggggcagcccagcaggccgctgaacaaacaccccagaagccagcactgtggcagggtgctggggagatgcccctctgagccttcctcccccctcagacctgaatgcaccccacagttgggggctgcccctgcccactcccctggtaatgcataaaaggggaggggaaggttccctggggcttgagctccctctgtggaggtgaggaggggagattccgttcacatcccaggaggggcaaaatgactgatgtatttttatgtatctacacagagagtgcattttctctccagagatgctgtctggttaacaaaggaataacttaagaaattgattgattatcttaataaactgtgcaaacccaamrrraaaaaaaaaaaaaaaaaaaaaaaaaaaaaaactcgtag

SEQ ID NO: 292 - DNA, 890 bp, Homo sapiens
  misc_feature (818)..(819): n equals a,t,g, or c
  misc_feature (829)..(829): n equals a,t,g, or c
  misc_feature (859)..(859): n equals a,t,g, or c
  misc_feature (887)..(887): n equals a,t,g, or c
cttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaaaaaaaaaaaaaaaaaaactcgagggggggcccgnnacccaatcgnccaaaagtgagtcgtattacaattcactgngccgtcgtttacaacgtcgtgactgggnaaa

SEQ ID NO: 293 - DNA, 1050 bp, Homo sapiens
ggcacgagcttttcagcatttgatggttgctgaccactcccactttcacagaaccctcatcaaacagccttctatgatcccaaatgcaactttctatcacatttttatgctcttcttctgcctactcatgaaaatgttggggccatccaggcttccatttttagccctcactttgtgcaggtttatactttattttcagttttgttatctgatctctgactccagcccagaccattcctgactccacatccacatattcatctggcttgctgaataacttctcttggatgtacatgtgtgccttagactcattatgtgcagacatgaagtcatcttttttctctccagacctgcttttcctctcgtattcttctttttggtgaatggtacaattattcagatggaacgtccaagtcaaaagtcgttctagaatcctccctcactcctaatgccacatccaattagtgaccaaatcctatcgattcggccttctaaatacagtcaaaacatttcattcaattcagcgtcactgtcattgctttaatgtagaccttctctattttaccatgatcaagcagaggccctgtatctatattcttctgccttccagtcttgtcatcctactccgcagttaatcccctgagtgctatcctagtgatccttctaacagtacagatttggtcatggattctccagcttgaaatacttcatgtcttttgtgggaacatggatggagatggaggctattatacttagcaaacaaatgcatgaacgaaaaccaaataccacatgttcttacttataagtgggagctaaatgctgacaactcatgaacacaaacaaatgaacagcaaacactggggtctacttgagggtggagtttgggaggagggagagaagcagaaaaggtaactattgggtactgaacttaatacctgggtgattaaataatctgttcaacaggcccccatgatatgagtttacctacgtaacaaaccttcacatgtatccccaaacctaaaataaaagttaaaaaaaaaaaaaaaaaaa

SEQ ID NO: 294 - DNA, 1161 bp, Homo sapiens
ggggaaacggagctctgggtgtgatatttcctctgcattttcctgtcggggtggtgaaataactggtttgaacccagtccactggactcgaaagctcatgctcagaagccccagggctccctctaactttcttggttgctgcaactcagagagcgctggaatggacccagggcatgctcctcatctcagcggttcaggttttcattcttctatctccatccttctatttaattctgtacttactaagacctgggggtacagggaggggcttggagcctatttgcccagctgctgaatggggaggttggagagatggatacttatggctccagtaccaggagccaactgtttcccttgacaactggggaaactgaggcccacagagccaaggccacttgcccgtggttacctaaagatgttaacgagaaatccgggtctggaactcagatccctttgtatcctgtttcggtgttggtgtagtttgttgctttccctaagatgagcccagatagggaaactgaagtgcctgggstcctggttgggtcttctgcggggagagaatggcgattcaactcccgtgtactgttgaacttgacacaaacacgctcacatcccaggctgcatacgtgttttgctttagaaatgacatgaagccttttgactatttttaagagaaaggcaatggctgtgatatttcccctgcacctccctctcggggccacttggttaaatgtcaggaaagggagagtatttcctggtcaggaacattcagagcttgctgggagctgaagttttgttttccattaagtaggtattcggggagtctatttccctctgcctcctctgtttccctggaarcttgcgcttgacagttgcagggaggaggggtttgagaatgagcagccgagatgcccacgtatcgcgtgcccgctctaggagtggcggggtggctatttttagccatcctgattcagtagaggcatttcagcgtttgttcaatatttaattatccatctgaaattggcccatgtggccttcagtttggaagcagctctctgtgctgtgatttcccagttgcataaataaggaagtcaagggaatctcaatagccctccaaataataataacgaaaaaaaaaaaaaaaaaactcgacggcacgta

SEQ ID NO: 295 - DNA, 2152 bp, Homo sapiens
ccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttatggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttccaaccttttagcatatctccaaccttgcaatttgattggcataatcactccggtttgctttctaggtcctcaagtgctcgtgacacataatcattccatccaatgatcgcctttgctttaccaytctttccttttatcttattaataaaaatgttg

SEQ ID NO: 296 - DNA, 1002 bp, Homo sapiens
ggcacgagcccagcggaagccaagccaccaggccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagggggggcccggtacccaattcgc

SEQ ID NO: 297 - DNA, 515 bp, Homo sapiens
  misc_feature (3)..(4): n equals a,t,g, or c
  misc_feature (7)..(7): n equals a,t,g, or c
  misc_feature (20)..(20): n equals a,t,g, or c
tanntgnatccccccgggcntgccaggaattcggcacgagttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatatttwwwwwgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaaaaactcga

SEQ ID NO: 298 - DNA, 1113 bp, Homo sapiens
  misc_feature (349)..(349): n equals a,t,g, or c
gttggtgttgagcacagctttaggcttagattcttcatcaactaggagaagctgtgcttcaatacagttattcgtttgcatggttcctaatgtgcttcactcaatttagcagaattttttttttaacctcttccttgacgctagctgcttgtgcaaatcacatcttggccgcctactcttcttcacttgctgacagatgtgtaggtgagaaaagtctcatagtcattgttcctgaaagaagcttccagacccacttctagggccagtgacatatgcaggaaatcagctgcttctgggccaggacagagctggtcttttttttagtgggggatggcgggcagtggggcangggacattcaaaatttattttccaacagacagatagcatcagcaggtacaactacaagggtatctacatagatcatacattcacaaggcattattagttcaacagtgagaaagccactcgtgggttttctgtaacaatatcccacttcatagtgtaaacaggtactattttgttcacttacaattccggaaggaagggcacaccttgcaggggggaagaaaaggggaatcctaaagtaaggtgcaacaattaagagacaacactttggctaacaatcttggatccacatttcagtcagggccttccacatagaggggaaagacttttctctcagaagttagaatctttcttcctcctttcttgttaaactgagagcagtgttttgtttgctcaatattacatgtacaaaaggagattagaagaaaatgcatcacaaaaccatcttgaacgttcagctcttcctgccaatacatcacaactcttaggttttagacggggcctgggaatacgtaagtgttttttcttttttttttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagtcttcatgaaatattcatcaagaagacaaaaaaaaaaaaaaaaaacctcgta

SEQ ID NO: 299 - DNA, 1254 bp, Homo sapiens
ggcacgagctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 300 - DNA, 697 bp, Homo sapiens
  misc_feature (19)..(19): n equals a,t,g, or c
  misc_feature (50)..(50): n equals a,t,g, or c
  misc_feature (57)..(57): n equals a,t,g, or c
  misc_feature (662)..(662): n equals a,t,g, or c
  misc_feature (680)..(680): n equals a,t,g, or c
  misc_feature (690)..(690): n equals a,t,g, or c
aagaaaattaccctcactnaaaaaaaacaaaaactaaaagctcgcacgcntgcaggnacgacactagtggatccaaagaattcggcacgaggccacatcccaccggcccttacactgtggtgtccagcagcatccggcttcatggggggacttgaaccctgcagcaggctcctgctcctgcctctcctgctggctgtaggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaactcngggggggggcccggttanccaatttggncctaaag

SEQ ID NO: 301 - DNA, 1668 bp, Homo sapiens
aatttcgaacacccataaaattgtaaagaattgtacagtacattttaacatattkgcttgttacaayctatacatttwawgttttttaaccacttcaaagtaagtttcagacaccaacacattttttaaatgatccctaccattttttaaatgatccctaccaaaatggaaggctggtatcccaaggttttgttccatttctcaattctagtctgtgaaattgargtctgatgaccactcttaagrgggctgttcattagggkgcgggctgggcattatgagtgtgtttttcatgagkcagtggaaggaggggcttgttgtgagcagtgcatgagaaaaacggcttggctttgcttctttttccagctctgtggccttggtcaggttacgtctcttcagtatcgtaactgtaatgtggagataaagccttcattagttaggggcacacaccgcagtattccttaagtcatcttgatgacaagtgaatgcaaggcagctggtacctttcaggtagtagttgaattcaggtagtattgttcagtttttttttttcccttcatgttctaagaccagctgagaggcaaagttgtaccactgagctctagttgttgttacctaaaaagsccttgttttaaatttctgtgatacctaagaatttcaaatctgggttgtcatggattctttattctttttttctcccttaaaaagttacattttagatgaaatcccctttyttaaaatgggcaaagcaataattctacatcatttctccccttcccttccacttgtttagactaagatatgttagagagggaaagggtcgttgttttagtaaatactattgctgttgacatgttaatactattgctgttgacatgtttactgatgggctgtgttccataattttgttttaggtcttttgtttgaaacagtttactgtttttatcagttttggtccctaatttttcctaacctacagtttttctctgagtacatatggtttcattgtttgatctactttctatctatctgaatatgaacttctaggatcatgtttattctagtagatgatgacttaaagcctgcagtataggagggacaacgtcaactactgcatgtgcaataacaagcttgaagggaagctaaatgtttgttacaaatttaagacagtattttaatgccgtttgcatttttctaagaattttctataaagctaattctgktattttttgtctctaaattagggaactgtccaggtttattgctgccgggagactacactgcaaaatagataaagtgaatgaaatagtagaaaccaacaggtactctcatttctcagaataagggggcattcctaaattttaaaagtaggkcaactattgkcatggaataatgtgactggtaaataattcattttttcttgaatttatttatagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgttaaaaaaaaaaaaaaaaaactcgta

SEQ ID NO: 302 - DNA, 887 bp, Homo sapiens
ttttttttttttttttttattagaataaatgttgttgccaaatgaaaacatgacactgtatataactgctgaggcctattctcatgtttaaccttcctaagccagttttcttaagttggtggagatggaagactatagtaattttcctagcatgtctggcatctgctgctataaaagagacagcagtaagcatgaagactgtgtttcccatatttgtccaaatcactttgattttgcttttagagtcaagagtcttaaaaattggtgatttttccaattttttctgctaatagtatatttaaaaattagcatatgctttaggtacatgaaactttaaaaaagtaattataatgtacagttaaaaatttatagtaagtggatctcacaattcattttctaattagtaattgatagttttacccattaaaatgacaatgaaaatatttttactatgggttttcctcccatttgtttctaatcatacctttgataatattttataaaggcttataatcatagcagggaattaatttactacttaaattttatgtatatgtacagtacatttaaaaattaagtagtcagggcatggtggctcacgcttgtaatctcagcactttgagaggccaaggtgggtggatcatgaggtcaggagttcaagatcagcctagtcaacatggtgaaaccctgtcactactaaaaatacaaaaattacccgggcgtggtggtgcatggctgtaatcccagctcctcaggaggctgaggcaggagaatcacttgaacccaggaggcggaggttgcagtgagctgagatcacaccattgcactccagcctgggtgacatagtgagactctgtccccctctcaaaaaaaaaaaaaaaaaaaaa

SEQ ID NO: 303 - DNA, 1532 bp, Homo sapiens
  misc_feature (1412)..(1412): n equals a,t,g, or c
  misc_feature (1433)..(1433): n equals a,t,g, or c
  misc_feature (1446)..(1446): n equals a,t,g, or c
  misc_feature (1505)..(1505): n equals a,t,g, or c
gctggagcggtttcattgcctacattccgcattggaaaatagaagcaggcacaatgaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaaggtaaggaaaatgactcggaaaatgtgcatgaaatgtactagggtttttgcttggttaaggtgcctaaatgcttaggtcaaataccctggcaatctgcatgttacatgctatctgctggcagtttctttctgatataaaaatgaaacagtattcttggacagaggacacagaatttctaattccagtggggcttgttttgctttcagtttcttataattgtacttggagaaacagatactgatcagtgttttatattctaaaagacagccaagttgaataataaagactttcgttttggcattttgttctttttactaaacataattaagtgtttaataagcttccttgtaccgagtgttgcataaaacacttaaaaggacacaattagtgccttcgtgagatttacatgctaattatgctaaygattgggtgctatgtagttaatgatttaaactgcatgcattgacagattactccttaggcaaaagtatttaagaagggataagtagaaattctgattggaatattaaaacattttttaaaaattaattatgkttagactgktgaaccgkgttatataattttaggataawggattwatttgctttttttttttttaagagaaactacttgaagtaaattcctacccatacttcttacttgtctcctttcctttgattaatctaaggaatgktgatgatgagaagaaagatggaaatgttgaggtggttgcatatttggtttgttagaatatctgtcatcacctgggctwtttgaagctgctgttgctgatgttgttttattgactcatgaagacaactgaaaagattgctttgtaaccttatttttttctgatgtgtgtttacatccatgtctatatatacatattgcatatgtatatatctgtatgtgcatgtatatgttaaaaatctgatataagtgaaaacatgctctgtgctttgaaacaaaaaaaaaaaaaaaaaactcgagggggggcccggtacccaattcgccctatagtgagtcgnattacaattcactggccgcgntttacaacgtcgngactgggaaaaccctggcgttacccaacttaatcgccttgcagcacatccccctttcgncagctggcgtaatagcgaagaggcccg

SEQ ID NO: 304 - DNA, 2441 bp, Homo sapiens
  misc_feature (2408)..(2409): n equals a,t,g, or c
  misc_feature (2435)..(2435): n equals a,t,g, or c
  misc_feature (2438)..(2438): n equals a,t,g, or c
gggtttctccatagcataaatgaaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacktcttggcacagaattgcttatcaaggaacatttccacaagaaagaaaatattaaggggttatttccacagargcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagaccgaaccaaaagtcttctgcagaatctcccaccgagtgtggtaagaaggaaggacaaaaggctttaggatataaatttcatgttacagagcatgtcaytgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaannaaaaaaaaaaaaaaaaaaaggggggnccnccc

SEQ ID NO: 305 - DNA, 1192 bp, Homo sapiens
ggcacgagaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgaaaaaaaaaaaaa

SEQ ID NO: 306 - DNA, 1559 bp, Homo sapiens
  misc_feature (1445)..(1445): n equals a,t,g, or c
  misc_feature (1551)..(1551): n equals a,t,g, or c
atccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagncctgcgcggagcggcggatccccccgggcatggcctgggctggttttgaatgaaacgacctgaactgtcaaaaaaaaaaaaaaaaaaacccgrgggggggcccggnacccaatt

SEQ ID NO: 307 - DNA, 1021 bp, Homo sapiens
gtaattccttaaacataccatctgtcacagttaatctagatttgtaaataggtagtaatttatagaatttttaaagcgtaaaatccggtaatattaaaagataggtaaacctaggcctggaaagctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgygtgaattaaagagattaaaggatagagtattctgtttctttgttttgatttggcttttaggtattaaaataaggcccagatcactaaaaattagtaacagagggagacctctaatagatttaaagtcagttaattctctctgaaatttgatgttttcttctataaagaataactctaaaataggcatcttcccaggactttccattctcaggaaaagacctagttacgtataaaaaataacttctactgctttatgtagtcatataggtctgcctaaaataagaatttgtatttaataaataccaaaattttcaaatggtaaaaaaaaaaaaaaaaaaaagggggggc

SEQ ID NO: 308 - DNA, 1024 bp, Homo sapiens
  misc_feature (5)..(5): n equals a,t,g, or c
  misc_feature (14)..(14): n equals a,t,g, or c
  misc_feature (32)..(32): n equals a,t,g, or c
  misc_feature (713)..(713): n equals a,t,g, or c
gtggntcccccggntggccaggattcggcacngggcgctggccgccttccagctgctcaacctgactgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgmctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctkggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacanacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgttaaaaaaaaaaaaaaaaaaaaaaagggcggccgct

SEQ ID NO: 309 - DNA, 621 bp, Homo sapiens
  misc_feature (488)..(488): n equals a,t,g, or c
  misc_feature (536)..(536): n equals a,t,g, or c
  misc_feature (539)..(539): n equals a,t,g, or c
  misc_feature (548)..(548): n equals a,t,g, or c
acagagtctcgctctgttgtccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggantactgctaaatacaaaagaaagtccaatatgtttccattctgtagggnaanagggatgcnggcttaaaattctgagcaagggttttttggcagtgcagtgttggcactatggaaaacccttggtcccccggaa

SEQ ID NO: 310 - DNA, 884 bp, Homo sapiens
  misc_feature (307)..(307): n equals a,t,g, or c
  misc_feature (356)..(356): n equals a,t,g, or c
tcgacccacgcgtccgccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaagtggagggtcttcatgaaacacagctgccaggagcccaggcacaggctgggggcctggaaaaaggagggcacacaggaggaggganggagctggtaggggagatgctgggctttacctaagtctcgaaacaaggnggcagaataggcagaggcctctccgttccaggcccatttttgacaratggcgggacggaaatgcaatagaccagcctgcaaraaaracatgtgttttgatgacaggcagtgtggccgggtggaacaagcacaggccttggaatcccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtgaaaaaaaaaaaaaaaaaaaaaaaaac

SEQ ID NO: 311 - DNA, 1231 bp, Homo sapiens
ggcacgagtgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagattagaatctagtgagagcctcctctctggtgggtggtggcatttaaggtcaaaccagccagaagtgctggtgctgtttaaaaagtctcaggtggctgcgtgtggtggctcatgcctgtaatcccaacattctgggaggcccaggcgggagaactgcttgagccccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcctatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggaaaaaaaaaaaaaaaaa

SEQ ID NO: 312 - DNA, 1223 bp, Homo sapiens
  misc_feature (1204)..(1204): n equals a,t,g, or c
  misc_feature (1206)..(1206): n equals a,t,g, or c
gcttagctcgaaattaaccctcactaaagggaacaaaagctggagctccaccgcggtggcggccgctctagaactagtggatcccccgggctgywkgaattcggcacgagctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtgccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatttggctaagcatacacactgttgcactggagggcctgaaccagccatcaaacgagagcctgcagaaggtncncagtaaggctgaagttt

SEQ ID NO: 313 - DNA, 1494 bp, Homo sapiens
gtcgacccacgcgtccggcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgcyttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggtttccctattccaatcctgtttgaaatggtttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgaactttggtttgatgccagtcaggtgccacatgagaacctttgctgagatgcaaataaagtaagagaatgttttcctgaaaaaaaaaaaaaaaaaaaaaaaaaaaaaaaaaaaaaaaaaaaagggcggcc

SEQ ID NO: 314 - DNA, 1216 bp, Homo sapiens
ataactcaggcccggtgcccagagcccaggaggaggcagtggccaggaaggcacaggcctgagaagtctgcggctgagctgggagcaaatcccccaccccctacctgggggacagggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagactgttgagaatgttcatctctccagcccctgaccccatgtctcctggactcagggtctgcttcccccacattgggctgaccgtgtctctctagttgaaccctgggaacaatttccaaaa

SEQ ID NO: 315 - DNA, 859 bp, Homo sapiens
  misc_feature (27)..(27): n equals a,t,g, or c
ccgggtcgacccacgcgtccggcagangcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctccaacccgcacgaggcccgcaaggtcaaccggctgctggagctggaggcacagactcacggagacatcctgcagtgggacttccacgactccttcttcaacctcacgctcaagcaggtgcgctggactggggtcacctgatcggggccacctgtccttcttgtccaaattaccactccactccagcctgggcaacaaaagcgaaaactccatctccaaaaaaataataataataataataaaataaaaatcacacaaaggccaaaaaaaaaaaaaaaaaaaaaaaaaaaaaaaaaaaaaaaaaaaaaaaaaa

SEQ ID NO: 316 - DNA, 1238 bp, Homo sapiens
ccctcacatcagggaaaatgaccttcactgctgttaacagtaatgkgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctawctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaaaaaaaaaaaaaaaaaaaaaaaaaaaaaaaaaaaagggcggcc

SEQ ID NO: 317 - DNA, 1189 bp, Homo sapiens
gcgtccgctgggctggaacagcacagaacccacagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgaccctgcctgtggcctacatcatcacagaccagctcccagggatgcagtgccagcagcagagcgtttgcagccagatgctgcgggggttgcagtcccattccgtctacaccataggctggtgcgacgtggcgtacaacttcctggttggggatgatggcagggtgtatgaaggtgttggctggaacatccaaggcttgcacacccagggctacaacaacatttccctgggcatcgccttctttggcaataagataagcagcagtcccagccctgctgccttatcagctgcagagggtctgatctcctatgccatccagaagggtcacctgtcgcccaggtatattcagccacttcttctgaaagaagagacctgcctggaccctcaacatccagtgatgcccaggaaggtttgccccaacatcatcaaacgatctgcttgggaagccagagagacacactgccctaaaatgaacctcccagccaaatatgtcatcatcatccacaccgctggcacaagctgcactgtatccacagactgccagactgtcgtccgaaacatacagtcctttcacatggacacacggaacttttgtgacattggatatcaataaggccaggcgtggcggcgattacgtctgtaatcccaggactttgggaggccaaggcgggcagatcacttcaggccaggaattcaagagcagcctggccaatatggcgaaactctgtctctactgaaaacaaacaaacaaacaaacaaacaaacaaagaaacaacaaaaattagccgggtgtggtggcacacgcctgtagtcccagctactcaggaggctgaggcataagaattgcttgaaccctggaggcggaggttgcagtgagctgagattgggccaccgcactccagtctgggagacagagtgagactgtctcaaaacaacaacaaaaaaatccctaacataatctcaaaaaaaaaaaaaaaaaaaaaaaaaaaaaaaa

SEQ ID NO: 318 - DNA, 496 bp, Homo sapiens
tcgacccacgcgtccgaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagcaaaaaaaaaaaaaaaaaaaaaaaaaaaaaaaaaaaaaaaaa

SEQ ID NO: 319 - DNA, 3153 bp, Homo sapiens
  misc_feature (1)..(1): n equals a,t,g, or c
  misc_feature (2584)..(2584): n equals a,t,g, or c
  misc_feature (2590)..(2590): n equals a,t,g, or c
  misc_feature (3153)..(3153): n equals a,t,g, or c
nggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattcttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcagacatttgtgtctttgatcctcaccctgtgaccctaaagggaagaaagcctgagtgtcaagtaactctgggcctcccctaaagagaaatggagatggtggctcatctaggaagtagaggagcagggggttcctggttctcaggccacgtgtgatctctgcccacccagggcctgccccagcctgcaggtattgctgtgtggtgggaacacccacttcccttgtgcacagcctttgagaggggatcgtggcctcagttccaggggttcctggccagggccaagtgctccttctgcagaggcctgcacgcatctcacccctttgacttgtatttccatggcttcccctccccacctgccccctagccctccctgactggccagcccctcagtagtcctcctcggccagggagaggagcacggccttgggtgtgttctcgaaaagggctgcccggttctgctgctgccccttcttcacccagtggccatagattcggaaagcgtaggcgtcgatgagccggcgcagaggccggagggcataggggtctcggatgacgatctcccgggtcacaggcttcacccggcgntactgntagtagatccgcactgaagccagcacggtcagagcgatcaccttgaacttcccccgggggctgaagtgccgcacttcctctaccaagtactgctggaagaaggggtgtgccaaggcctcttccgctgtgtagcggttctggggttgcaccaccaggaatcgggagaccaggtccttcacggtgtccgagtaatcatcccactcgggcgagccaaactggtagttgccgctcatgatcatcctcagcatcagcatctgcttccggtgccagaagggcggggagccggccagcagcgtgtacatgatgacgccagtgctccacatgtccacctctttcccgtagcccgggtggtcctcattcatggagcactcgataatctcaggggccaggtaactgggggtcccgcagacctctcgcagcctctctcccggctccagctggcaggaaaagccaaagtctgtgagcttgatgttcatgttgtcatccaagagaatgttctcgggcttcaggtcccggtgcacgatgttgagtttgtgcaaggtgcagatcacctccagcagagn

SEQ ID NO: 320 - DNA, 686 bp, Homo sapiens
tcgacccacgcgtccgaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtgggactcaaggcttgaccgactcctagtggacctgatgtgaaattcctgtcaaacaaacaccacttttcaatggtttgctaggagtatttctgtattgaaagtttctaattatgctttttaaaaaaatactaaaaataaaggttcaagctgccaaaaaaaaaaaaaaaaaaaaaaaaaaaaaaaaaaaaaaaaaaaaaaaaaaa

SEQ ID NO: 321 - DNA, 2352 bp, Homo sapiens
  misc_feature (1)..(1): n equals a,t,g, or c
ncaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaggaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtgtggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgacagccccatcccaggatgggtgtctggggagggtcaagggctggggctgagcttta

SEQ ID NO: 322 - DNA, 1297 bp, Homo sapiens
ccacgcgtccggactgctttacggacattggatgaagccgaagcatttagaatggtgcctggcacacagttggtgcgtgatatggttaagctttgtgtccccacccacatctcatcttgaatgtgacggtttccccggctccctcctgccgccatgtgaagaaggtcgttgcttccccttcaccttccaccaccatgattgccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctatttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcaaaaaaaaaaaaaaaaaaaaaaaaaaaaaaaaa

SEQ ID NO: 323 - DNA, 1105 bp, Homo sapiens
  misc_feature (797)..(797): n equals a,t,g, or c
gggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtargcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagytagggaagcaggacaggcacacccagggaaggggaagagtcgtcgtcagtcacagtaattgatatctttggaatcgtctaagagatacttagcgtgtgcctaaaacattcatttctttttttgtttgttttttgwgacgaagtctcgntctgtcgcccaggctggagtgcagtggcgtgatctcagctcaccgcaacctcctcctcccgggttcaagcgattctcctgcctcagcctcctgagtggctgggactgcaggcacacactaccacgcctggctagttttttgtatwtttagkggagacggggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagggcggccgc

SEQ ID NO: 324 - DNA, 2496 bp, Homo sapiens
  misc_feature (2340)..(2340): n equals a,t,g, or c
  misc_feature (2373)..(2373): n equals a,t,g, or c
ggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgaggcagacagagtcttggctctgtcacccaggctggagtgcagtggcgcaatctcgggtcactgcaagctctgcctcccaagttcatgccattctcctgcctcagcctcccaagtagctgcgactacaagcacctgccaccatgcccagctaattttttttttcagtagagacagggtctcaccatgttagccacgatgctcttgatctgaccttgngatcccgcgacctcggccttccaaagtgctggnaatacaggcgtgagccactgggccttgccaagattgggcactttttaacatcagaacttcctatcactgctgcattgagttgctccgcatttattagaagcattatgcctgtacggattgggg

SEQ ID NO: 325 - DNA, 549 bp, Homo sapiens
tcgacccacgcgtccgggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactggggatgtttggcggaagctgtctcagtgattcagtccattccaatattcaatgagaccggacgattcagtttcacattgccatatccagtgaaaatcaaagttagattttccttttttcttcagatttatcttataatgatatttttagggttatacataaattttcgtcacctttataaacagcgcagacggcgctatggacaaaaaaaaaaaaaaaaaaaaaaaaaa

SEQ ID NO: 326 - DNA, 1001 bp, Homo sapiens
  misc_feature (919)..(919): n equals a,t,g, or c
cgcgctggaaccctgtggcggcggccatggccatatggcgctgcccgcctggctgcagccaggtataggaagaatgcgtatcttttcatctattacttaatccagttctgtggccactcttggatatttacaaatatgacagtcagattcttttcatttggaaaaggtaaaactccgaaacagtttttttatttttaacttttaatccttgttttcacctcatcctgcttatattaaatttctacacacctcaaccttctaccacgggatacagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcaagaggaagtccaagagaaatatgtggtgtgtgttttattcgtcttttggaatctattggatatggttaggtacacttatagcatgttatcagtcataggaatatcctatgctgtcttgacatggctcagtcaaacactatggatgccaatttatcctttgtgtgttcttgctgaagcatttgccatctatcaatcgctgccttattttgaatcatttggcacttattccaccaagctgccctttgacttatccatctatttcccatatgtgctgaaaatatatctcatgatgctctttataggtatgtattttacctacagtcatctatactcagaaagaagagacatcctcggaatctttcccattaaaaaaaagaagatgtgaagtacagcattccagtgtgacacgagaaaagacaggctgtggattcagtgcagtaaataaaacacaggaagtattctggtggaaaaanaaaaaaaaaaaaaaaaaaaaraaraaaaaaaaawaaaaaaaaaaaaaaaaaaaaaaaaaaaaaaaaaaaaaaaaaaaaaaaa

SEQ ID NO: 327 - DNA, 1142 bp, Homo sapiens
gaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaaaaaaaaaaaaaaaaaaaaaaaaaaaaaaaaaaaaaaaaaaaaagggcggccgctct

SEQ ID NO: 328 - DNA, 1432 bp, Homo sapiens
acgagagatttaagtgcagcgtggattttttttttctcactttgccttgtgttttccactccgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtgaaaaaaaaaaaaaaaaaaaaaaaaaaaaaaaaaaaaaaaaaa

SEQ ID NO: 329 - DNA, 2238 bp, Homo sapiens
  misc_feature (12)..(12): n equals a,t,g, or c
  misc_feature (45)..(45): n equals a,t,g, or c
tgtccttgttgncgcggctgaagtacgccgtgggccacttcctcnaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactgaggagggggacctgggggtgactaggtgacataatggggatcagcacgggcggcaccagcacacacgtgctggaatgagaactcagccacaaggggaggtgcgaagttctgacccaggccacagtgcggatgcacctttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacaagggctgcctttctggggtgatgagaatgttctggaatcagaatgggatggctgcacggcgtggttgaagggtactgaaggccacccttcagtgtacgaaggggtagatttttgtatttttaccaacaataaacaaaaagaaaagaaaacaaacaaaaaaaaaaagaaaaagataaaaagaatagagaacaagaaagaaaaaaaaaaaaacaaggggggactttttgggcgggggagaaagggtataaagggcgcggggtcaaaggtttcgagcacccttttttacaagagggaataggggcccata

SEQ ID NO: 330 - DNA, 1048 bp, Homo sapiens
ccacgcgtccggcagtgaacactctttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgagcctgggaagcagaggttgcatgggccgggatcacgccactgcactccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcacggtggctcacacctgtaatcccaacactttgggaggccaaggtgggaggattgcttgaggcgaggagttcaagaccagcctggccaatatagtgagaccccatttctgtttttgaaaaaaaaaaaaaaa

SEQ ID NO: 331 - DNA, 1021 bp, Homo sapiens
  misc_feature (971)..(971): n equals a,t,g, or c
  misc_feature (1004)..(1004): n equals a,t,g, or c
  misc_feature (1008)..(1008): n equals a,t,g, or c
  misc_feature (1010)..(1010): n equals a,t,g, or c
  misc_feature (1018)..(1018): n equals a,t,g, or c
ggccgcccttttttttttttttttttttttttttttttttttttggccttagtcatcatttcttgaataatacaaataggtaagacaattttacaaaaattgtgctatagaataggatatttgtgactttttagatgaaatattagagctaccccacccagccacagatagcactgtaacactttcttaatagagtataggttcaaattataaagtccacacactggctaaaaagttcaagttcagagtttcaatcaattttcattgtaaggatgaaactgagttttactcaacttgtgtctttttaagagaatgggccacctcccacacatcctttctcttggactttttttaacacttctaatgttctgtatcacgaaatcagatggccaaaacaaaatctacaggtgctttaaaaaagcaagtccccaagtgattgttacccataccaaaatgagaattgctgctataatctgttcttactggamtggccakgccaatcttgggactaggattaaattgcaattaaattckgcagtgtacaaaatttttgtcagtctgyctagaaaaagaaagagaactctttcatggtagagcagttactgtgctcacgttgctttttctaaaaaccaacctactttcaaacaaagaatgaggaaatttgcagtaaattttaaatatgagtcacggaaatattaagataatagcatgtgtgggcaataataagtatgccaagaaataaagagtaatatacaaaacaatcaaacattattacatttggctacgaggttcctaataaacagggcaaaataaatagtgaaatataataaaatcgttatcatctgataaaaggctgcatggtacttttcccaaacgtaatggatgacttcaacacattttcttattaaatatttcaaattgtttcttcatgtgaaaactgtcttattaattgtaaaaaggatgtaacttgnataggcatgctcaacaggggtaagagtaattcngtangngccccctngat

SEQ ID NO: 332 - DNA, 1052 bp, Homo sapiens
acgcgtccggccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggacctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctagcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagcaaaaaaaaaaaaaaaaaaaaaaaaaaaaaaaaaaaaaaaaaaaaaaaaaaa

SEQ ID NO: 333 - DNA, 1492 bp, Homo sapiens
gccttcccacactccattccctgtcaagttatggctgtcccctcaccccagctgctcctagagaggcccttkttacctgtgtcattcatgtttctaacaagccaccctccaccccgtcttgtgtgccccatgcacctgtgcatctgtgctgtgtgggtgttggtggcccttttgcgcatgcatggggcatcccctgcccagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccaatgatggcacacggacggcccgcaccaccacagtggagtcgagtttcgtgaggcgctcggagaatggcagtggcagcaccatgatgcaaaccaagaccttctcctcttcctcctcatccaagaagatgggcagcatcttcgaccgcgargaccaggccagcccacgggccggcagcctggcggcgctcgagaaacggcaggccgagaagaagaaagagctgatgaaggcgcagagtctgcccaagacctcagcctcccaggcgcgcaaggccatgattgaraagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaamccctgctcggggccccacggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaamraaaaaaaaaaaaaaaaaaaaaaaaaaaaaaaaaaaaaaaaaaaaaaaaaaaaaaaaaaaaaaaaaaaaaaaaaaag

SEQ ID NO: 334 - DNA, 609 bp, Homo sapiens
ttctgttcatttttccccctttctcccccacattcattaagaaccctactgaaaccctaggtgacaaaaggtgtgccttctgttgccacatttgacccaccacaggactcactggactggacttctatttatatggtattaagtaactgatatatatatatatatatakttttgattgacaccaaaaaattaccttggcacaaatgccagacctgtgaaggtcagaggcccgctgcttytcccaggagggagggaactttttggttgtctgtggcaattcctctgtacagattgtaactttttaaaaatttcccttcaccccgtcacttgaatatatgttcatagtaatttgtaagatacttcttttccttattttggttgcaagacccttccgaacacattcctgtataaagtattttgcactatttaaagaaacccatatggatgaagtcaggatgtgcaatatgatggcgtcacagtgctcatcgttgtacctgtaatgtaactaatcagtttaaatgtactattttaaatatgtaaaataaattttcaccatgagcatgttttaatgaaaaaaaaaaaaaaaaaaaaaaaactcsagggggggcc

SEQ ID NO: 335 - DNA, 2784 bp, Homo sapiens
ggcacgaggaactctgagcaccgtggcttccagcatcaatgccttggcaacagtgacctttgaggattttgtcaagagctgttttcctcatctctccgacaagctgagcacctggatcagtaaaggcttatgtctcttatttggcgtgatgtgtacctctatggctgtggctgcatctgtcatgggaggtgttgtgcaggcttccctcagcattcacggcatgtgtggaggaccaatgctgggcttattctccctgggaatcgtgttcccttttgtgaattggaagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaatggactcaggagagaaagcctggtacatgttccaggctatgatcctaaggacaaaagctacaacaatatggcatttgagactacccatttctaaggcaatacctgtatgaacgcacacacacacgtgcaatacacacacacacacacacacacacacacacaaactccacatacttcttgcctacttgttagtagatatgtatagttgccattgctagaagacagggatgtctggtgcctatttctacttatttataactacatgcaaaatgactatctctcgggatattcttagaaagactccaactttcacagagaaaaaccaacctgctccaaatgcccttgactacttccttcttgaataaattagggctggatttcattaccattcaagaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccccgacctcatacctgacatacatgtagacatattttatgccacccatctcccatcctgtagctacaattggcatacaactactattaacctcccttcaccaccactgtcaggtcctcttccagtcattcctcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctggagcctttttccagggctaaggaaagagaaaaggaatgtcctatagaaggttgttaggatagaatttggtaaaagaacgttgcagatattgtaacagaccataggagatttcatcagcaataggattcttctttggagaaaatacattgtccataagacttgtactctattcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattctgtgaatattgaaatctgagccaaaactagttagctttattaatatcttagggaaagaagagagaaagaaagagggagggagagagagaaagaaagaaagaaagaaagaaagaaagaaagaaagaaaaaaaaaaaaaaaaaa

SEQ ID NO: 336 - DNA, 943 bp, Homo sapiens
gtattttcaagggtctgtcctgttatagcacataacggaacttcattccttttttaaaagatataattcatgtaccaggtgattcacccctttaaagtctcaaattcagtggtttttagtatatttccagaattgtgcagttatcactaggagcaattttagaatgttttcatcacccggaaagaaactctatatccatacgcagcctctccccatttctccccaacccccagccctaggcaaccactcatctgctttccgtgtctgtaggattgcttgttctggaaatgttgtatacatggaatcatgcactgtgaactcttgtgtgtcacagaaggatcatgtttccatggtgcgtctgtgtcatagcatgtatcagtgcagtaaccccccttatccaaggttttactttctgcagtttcagttacccacagtacagtacagtaagatattttgagagagagaccacactcacattacttttattgtaatatatcgttataattgttctatttgattattgttgttaatctcttactgtgccttatttagaagttagactttgtcataagtatgtatgtataggagaaaagatagtatatataaggtttggtgctatccacagtttcggacatcccctgggggtcttggaatgtawcctgtggataagcgggaccactgtacttcattcctttttattgtcaaataatattycatkgkgtggctawgccatawtttgccyattcattcgtcagttggtagacatttgaggtgtttccatwttttggcttttgtgaagaatcctaggccgggcacagtggctcatactcctgggaccttgggaggccaagacgggacgatcacttgagctcaggaatttaagaccagcctgggcaacatagtgagactctgtctctacaaaaaaaaaaaaaaaaaactcgag

SEQ ID NO: 337 - DNA, 1794 bp, Homo sapiens
  misc_feature (1675)..(1675): n equals a,t,g, or c
gctcctctagtgactgctggggtgctagttttcacggttaccacagaacttgagagaggaaaatgagaacggcaaattaaaatgccataaaattccattcttaacaagcgttagtttttttttcctatatatccactccctcacctatcttatgacatatgagaaatcctaacatgggacttggtgtataattagcattgaatgaatttaagttttctttctttctttcttttcttttatcttctgtggtctcctgcagaatcagtctataaaaagggcatggtaaaaaaaaatctatctcatagcattgttgaaaagattaaatgacataataagatgatgcatatatagtagctagcactgtacctgatgcatattaggagcttgataatattactaacattatcatcatcaatgctatctgagcaaagaggctgttccttctttccagccagagttcttctgttggataatatttccagctgtgaaccccaaccagagaccttgaagcctttatttccttttctctcattggcctttggctgaagtctcctttctgcagagaacaaagtgaccagcttttgatgaactattttcctcttttatccatttccaagtgttagccatagtgaagaagtgtagctgggtgctagcccaactcaagaagtgataatgtwatatccaacccaagataaactcaaggataactttcaacacggctactcaagcagttcaggggggaggcatcttgtagagaggagaccaggaagtcacttggcagctgggccagcacacagagggccattgctccagtaaagcagctaacctccatctcttcatcaaaccatcctagactcagcactctgcagagaaggagcagatggagggaatgtgtggagagattagataagaaggatttctaatctagtgggggagcgagtaaaatgtacagaagtttgagaagccaagctcttatgtammaatccrcccccatcactcaacaatccccactgtatgaataaagcctggaaagtttccaattaaaacagtgcttgtgaatattggcaaggggtatctttgtgtgcagggtacatttaaagggagaagggtgaagatacacccttgccttytaggagtacactttctgagagcttgttcaccaggctgtgagtttctcagtctatctgtttctcagtctgttagtaatgaatgtatctcccacttagcacagcagctagcacatagtagatgcctaacaaatgtgtgttaaattgaatgttggaagtctgtgtcctgaaagcttttcttcacatattacaaggctttttatttgttcaacacatttttaccaagtttttttctgtgttccaggtcttttgattagctgtttttaagtcacagaaatgggtgtcgggaacaaaaccagtcaaaagtcctcattctacatcatttacactttcccttcctatatttataagttttaatatcagcttctacaataggttccagaacaagtggtgctcaaggaatggagaaaatgactattccaaccctagctgtaggtgaaccaaaaaccccagagaaatcaaagtgtagtttaaagcagtgcttctcaagttgtaatgtgcatatagatcacctggggttgttattaaaatgcaaattctaaaagagncaggagaatatcttgagcctgggagccagaggttgcagtgagccgagatcattccactgcattccagcctgggtgacacagcgagactccatcttaaaaaaaaaaaaaaaaaactcgta

SEQ ID NO: 338 - DNA, 887 bp, Homo sapiens
  misc_feature (303)..(303): n equals a,t,g, or c
ggcacgagagaattataggtgcatgatggggcttttggagactggcaatgttctgttttgggtctgggtagtggttacttgtgtgtattcactttatgctaactcattgaactgtacagatatggactgtgcccctttctatatgtgtgtaatgcttcaacaaaagtgtcaatagtgatgcatgcacatgttaaaatttcaaactatattaaagagtgtgcaattaaaaggaagttatcctctcactctaaagtcctatttcctctcttcagtctatcattactactagtttctagtatatcntttagaaatgkgctgtaaaagaacaatgatgtgtatgtctctacaggtatatatttattctttttgtaattacaaaaatataaactcactacatatgttattctaccacatgctttttttcatgtaacagtatgtcttagacatcttttcctattattgcgtggaagctatcaaccttattctttgtaatgactccataaattattctactgtgaaaacacaccatgtttaaccagttctctgttagtgaacatttaggatttttccagtttttaaatattacagtgacatattaaacattaaacatatcttttgacacatgtccttgcacacatgtataggtatgatggactttaacaccctttggctagattctttagcacataacgtaaatatcccatagagtcaaaaccacccttaaaacttcctcaggaggctgggtgtggtggctcacgcccgtaatcccagcactttaggaggccgaggtgggcggatcacgaggtcaggagatcgagaccatcctggccaacatggtgaaaccctgtctctactaaaaatacaaaaaaaaaaaaaaaaaactcgta

SEQ ID NO: 339 - DNA, 1780 bp, Homo sapiens
tatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacckggagtgccacacccctctctctgccagttcagctcttcattcttcaaggcctgaccttgtctgacccttgtgcctctaaacccgtggccccacctctcttgggcacgagctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcattgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcaactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgagttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggggggtacatggggccttcagttgtgttttctttgtttttttctaaaaattgatgcagaggcatcacaatgttaagattttaacagggtagtgtggtgggtactttttaactgtttgcttaaagtgtttcaaagtaaaaatatttcttaaaaaaaaaaaaaaaaaaaaaaaaaaa

SEQ ID NO: 340 - DNA, 1984 bp, Homo sapiens
  misc_feature (598)..(598): n equals a,t,g, or c
ccaagctcgaaattaaccctcactaaagggaacaaaagctggagctccaccgcggtggcggccgctctagaactagtggatcccccgggctgcaggaattcggcacgaggcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgncttcgtggagtcggtgctgctgggcattgkgatcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaaaaaaaaaaaaaaaaaaaaaaaaaaaaaaaaaaaaaaaaaaaaaaa

SEQ ID NO: 341 - DNA, 1222 bp, Homo sapiens
aattcccgggtcgacccacgcgtccgagcccagcaacgtgcaaggggaaaggggacaggattctggatggccatttgcttcactgggatgcaaaacctcttttgagtactagaatcagtatttcttcttccatctctgctgtacctgagaagaaatggccaaacgcaccttctctaacttggagacattcctgattttcctccttgtaatgatgagtgccatcacagtggcccttctcagcctcttgtttatcaccagtgggaccattgaaaaccacaaagatttaggaggccattttttttcaaccacccaaagccctccagccacccagggctccacagccgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcccaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacataccacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagtttttcattcagcaagtctgcactagggacctactatgagccacgcaatacttccttggaatgatgtattccctggccttgaaataaggaatctagtacccatgtttgtgctactggaatgaatccattaaactctctgagactcaaaaaaaaaaaaaaaaaaaaaaaaaagggc

SEQ ID NO: 342 - DNA, 1815 bp, Homo sapiens
cacgcgtccgcggacgctgggctcaatctcctgaccttgtgatctgcccgcctcggcctcccaaagtgctgggtttacaggcatgagccacagcgcccggctgagtattgggtctttaggggtcaaaacttttgatctttgcttgcagtttttgtttttttctcttttacactctccctgttccctgattaaatgaaggccaggcttgcctagttccagggaaaaggcccagggtgcctagagcaaggtggatgggactttgttcgcagatgggccttgagagagcgacccctcgctcctaaatgcccggaggaagggacggacttctttatctttaccatgggtattctgccttactgctttggcctgtggcgtttcttcacttgcttttcctcattttgcttggaatgtgctttgcctgttgcatacccacctcgtctgcccccttgcacactccatggctggcctaaaagcccagtctgctgtcctgtgccctttagacttccactgtaggattatgtttccacactccctgtggactgtgccactggagctctctgcagacagggactgtgtcaggttgacctccatccttcagaccagcccagtgcctggcaggtagaggaaagagaagctgaggaaggacttgctgcacaagtggatgccaggagctctggtcttcccttcttgaatctgctaccttatgatgggagggacacagggctgtgctggatttgtgcacgatgctttggacagcccatgggagagggccaggaggaaggaaacccagactgagtggatagcaggctggatgggggcattgacagtgggggaagcattaaaggccatttatagccttcacaggtcttggtaatgggctcttacacgggttggtggcggaaggacacaggtggacctgggctggtggtcactcctgggctgctcttggccctggcatctgagacctgttggccaaaggctttgatgtggctctggtattttttcttttttttgagaatggaacttttttttttttaatgaaatgctcttttgaataggcaatacagtcacgtttctaaaatgaaaatatattaaaatatattttaagaaattttgcccctcactcctgatctcatctctgtcctccctcctccctggtaaccacctgtagcagtttgaatacccttctagtttttcttaatgcaagtacagcaaacacaaattgtgtattattatttctcccttttcagtaaatgaaagatagcattctgtgtgtactgttcttcatcttgtgctttttttaacttattgtagagatttttccatatcagtgcatggagaatggttgtcattctctttcagctgtgttgcactgtgaagttgtccctgtttgaatactcacccctgaggaaaggcacctggctgtttccagcttgtttcatgacatgccggcgacagttgtctcacgtgcacatcgtttcccacattgcagtggtcctgcagggtggcatcccgcaggcacattgctgagtcaaagaggaaacacagttgtaattttgacagattttgcccagttgccctctacagggcttgttccatgttgcactcccactggcggtgttgatgcctgattccccactgactcgtcaacacaaggtgtagtcaaatgcttggagttctgccagcctgaccaacatggagaaaccctactgaggatacaaagttagccaggcatggtggtgcatgcctgtagtcccagctgctcaggagcctggcaacaagagcaaaactccagctcaaaaaaaaaaaaaaaaa

SEQ ID NO: 343 - DNA, 1346 bp, Homo sapiens
cgctggggccgcgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtggggcaggggtttcgggctggtggagcatgtgctgggacaggacagcatcctcaatcaatccaacagcatattcggttgcatcttctacacactacagctattgttaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccacacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaaccatgtgtctgccatggactgtggtgctgggcctccctcggtgttgccttctctggagctgggaagggtgagtcagagggagagtggagggcctgctgggaagggtggttatgggtagtctcatctccagtgtgtggagtcagcaaggcctggggcaccattggcccccacccccaggaaacaggctggcagctcgctcctgctgcccacaggagccaggcctactctactgggaaggctgagcacacacctggaagggcaggctgcccttctggatatgtaaatgcttgctgggaagatcttacttgagtttaactttaacccc

SEQ ID NO: 344 - DNA, 1262 bp, Homo sapiens
cctaatggcccgasctgaatacttgaaggagctcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcaggtarcttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctgctaaaaaaaaaaaaaaaaaatttctgcggtccg

SEQ ID NO: 345 - DNA, 989 bp, Homo sapiens
  misc_feature (955)..(955): n equals a,t,g, or c
  misc_feature (979)..(979): n equals a,t,g, or c
acgcgtccgctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcatccccgacggcatctatgacccagcagacatttctgaggggagcacagctctatggatcaacactttcctcggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaactcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaagttgttttaagttttgtaataaacaagatgatgtctgaaaaaaaaaaaaaaaaaanaaaaaaaaaaaaaaaaaaaaaaanaaaaaaaaaa

SEQ ID NO: 346 - DNA, 632 bp, Homo sapiens
aattcccgggtcgacccacgcgtccgcgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggtggaaaaaaaaaaaaaaaaaa

SEQ ID NO: 347 - DNA, 2572 bp, Homo sapiens
  misc_feature (2527)..(2527): n equals a,t,g, or c
aattcggcacgagtctggaccttcttagmttgcttgatatcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttncattatgggtaactgggggaataaatggggtcactgggagtaggg

SEQ ID NO: 348 - DNA, 1488 bp, Homo sapiens
cgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgaaaaaaaaaaaaaaaa

SEQ ID NO: 349 - DNA, 609 bp, Homo sapiens
ccacgcgtccgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggaaaaaaaaaaaaaaaaaaaaaa

SEQ ID NO: 350 - DNA, 612 bp, Homo sapiens
ggtcgacccacgcgtccgagcatttgtctgtataattttagttattgaattaaaatcttttgggaccccaacaggatgagatcattggccagctggcttcctcccacctgcacctggactgaaattccccgtggcattagaggtgtttcgtaaggtgctccctgctgtctgtcctacagattgcagtggctctgctggaaaagaacggaattctatgcaagttgcgtgtgtcatgaaggtctctgcacagtgggtgtgtttctttgtcgtcttttctccactctgctcttctgtgaaatgtgccagcagtggacagaacaggggcagaggtgatcagtgaccattgcacagaatatcagtaagtgttgtaaggtatatagtcttggccaacaaattgtaagcaaaataccaggaacttcctaatctagtaggaaattttgtatgcttttgacaaacatctgatcctactgacactgaaagtccttagaaggagaattgcttgaacccggaaggtggcggttgcagtgagccaagatggcgctactgcactccagcctgggcaataggaatgaaactccgtcaccaaaaaaaaaaaaaaaaaagggcggccgc

SEQ ID NO: 351 - DNA, 704 bp, Homo sapiens
  misc_feature (287)..(287): n equals a,t,g, or c
actgtgtctgtcttgtctctgatatttatatgccattatgtggcctctactgccttaggattctaatgttcccactaagatcagctaactcagttccactacagtgtttaccaccatcatctctcgcaaacaaagacagccacttcagagctcctaggaaatagtggtgctcccatcatcattgcattccttaatsacatggtgaaaattaacaatggctaaggagcctttgtgttttctcctctacaatatgcccaggaatttctggcattttggccatcttattnataggctattactgaatttmagcctmatcctmccaaattattaatgccaaaatattaactcttgattcttaggtgagtgcacccatgccaataaatttgccatgatctaaccttaaatgtattctcatatatgctgtccaagtttctrctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggcgacagagcaagactccatctcaaaaaaaaaaaaaaaaaaactcga

SEQ ID NO: 352 - DNA, 613 bp, Homo sapiens
  misc_feature (25)..(25): n equals a,t,g, or c
gaattcggcacgagcgggacgcggntgaagatagcctgcggagtgtccgggcggaacacggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcga

SEQ ID NO: 353 - DNA, 1022 bp, Homo sapiens
ttcccgggtcgacccacgcgtccgcccacgcgtccggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtgcactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactgaaaaaaaaaaaaaaaaagggcggccg

SEQ ID NO: 354 - DNA, 1766 bp, Homo sapiens
  misc_feature (14)..(14): n equals a,t,g, or c
  misc_feature (36)..(36): n equals a,t,g, or c
  misc_feature (1750)..(1750): n equals a,t,g, or c
acgggggctttaangggaaacccttcccggaatttncgggtcgacccacgcgtccggttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgagtcctcgtccacagaaccgtccctcctggtcagctggtttacgcgcctcaaactgttgactcactgagagggaccctgctcaggccacctgcctggctcctgscccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttaaaaaaaaaaaaaaaaaaaaaaaaaagggcggccgctctagaggatcccgcgaggggccccanattacgcgtgagcgtt

SEQ ID NO: 355 - DNA, 1191 bp, Homo sapiens
ccacgcgtccgcacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcctaaaaaaaaaaaaaaaaaaaaaaaa

SEQ ID NO: 356 - DNA, 815 bp, Homo sapiens
  misc_feature (406)..(406): n equals a,t,g, or c
  misc_feature (794)..(794): n equals a,t,g, or c
ggcacgagcggcacgagcggcacgagatggaatgttcattttatggcagttgttttaagttktaaawtacacagaggaaamtattgtggaaggacctctttgttgctttcccttctaagttgtcttcttcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgrtgagccatcagaaaacttaatttggaaaacatgtatgtagccagtgtggatattgtggcctctctcaagacacattgacnactgtagacytcattcagtccagtgtgagtattttggagtaggttggatgtagattttgtttttatcgttgatttgtaccgacagaaatagacatttcatcatgtaaaattcctgttattctggaaaaacctattgttttgatccttcttgttttcctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaaaaaaaaaaaaaaaaaaattnctgcggtccgcaagggaattc

SEQ ID NO: 357 - DNA, 787 bp, Homo sapiens
  misc_feature (444)..(444): n equals a,t,g, or c
  misc_feature (506)..(506): n equals a,t,g, or c
ggtggtgtgcgccacccagaggctctctgtgggtccctagtggggaaaatgactcctccccacctacagtcttggtcagcagccccactgagctgtgttcatgttgacttccagctccaaccttatctcctgggtcctgccagagttgtcctctctgttgtgggttttcttgttctggaaaaggcagtgtggtgactgggcgggccggaagaccaggtccagggtctcaggagttgtcactaatttcccactccattccccttcactccgttacagctcctttttggaatgaggggacgatgctcaggaagagaggaggtattggaaaggaaagagaccccttcatcttcctttttagccctgctcaacctggctggctatttctgggagggccctttagagttgctgtgggcctctgcctatgtctgtgcagggcataggcantgcacasacagttgccacacccagggtggamaaatccccatggtggccttgtctgctgtcanttgcataggaaatctgataacctaagatttttttttattttttattttgagacagagtcttgctctgtcccccaagttggagtgcaatggcatgatcttggctcactgctacctccaatcctggatttgagctactcaggaggctgaggtcaggggaatcgctggaacgcgggaggcggagcttgcagtgagccgagatcatgtcactgccctccagcctgggcgacacagtgagactccatctcaaaaaaaaaaacaaaaaaaaaaaaaaaaaactcgta

SEQ ID NO: 358 - DNA, 633 bp, Homo sapiens
ggcagagtgtctctcaatggcttctttcttgaagggcatcacagccactgtacttatcaatgcctgtgtagccaacacagtagctcctctacattacaaggatatgattattcctaaacttgtcgatgatctaggaaaagtaaaaatcactaagtcaggatttctcacttttatggacacttggagcaatccactggaggaacacaatcaccaaagtcttgttccattggaaaaggcgcaggtgcccttcttgtttattgttggcatggatgatcaaagctggaagagtgaattctatgctcagatagcctctgaaaggctacaagctcatgggaaagaaagaccccagataatctgttacccagaaactggtcactgtattgacccaccttattttcctccttctagagcttctgtgcacgctgttttgggtgaggcaatattctatggaggtgagccaaaggctcactcaaaggcacaggtagatgcctggcagcaaattcaaactttcttccataaacatctcaatggtaaaaaatctgtcaagcacagcaaaatataacattgtagccacagaccagataccattaataaaaatcctattcataaaaaaaaaaaaaaaaaaaactcgta

SEQ ID NO: 359 - DNA, 989 bp, Homo sapiens
ggcacgagcatgccagtgcctactctgtgcctgctgtgggccctggcaatggtgacccggcctgcctcagcggcccccatgggcggcccagaactggcacagcatgaggagctgaccctgctcttccacgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagaggtgagcctggcaggggtttggcaggcagggcagttggatggggggcgcacagggcagctggaaaggggccccctcacctgggctgagccacatctccctccccagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctcaaaaaaaaaaaaaaaaaaaaaaa

SEQ ID NO: 360 - DNA, 774 bp, Homo sapiens
  misc_feature (24)..(24): n equals a,t,g, or c
  misc_feature (39)..(39): n equals a,t,g, or c
  misc_feature (43)..(43): n equals a,t,g, or c
  misc_feature (67)..(67): n equals a,t,g, or c
cgtgctggcggctaccctgcatgnggacgcggcaccaantacnagcgcttccccgactggctggaanactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgttcgttcatcctgggccaaagccctgtttctcctgccctgcatcagccgcagactcgccaggatccggagaggctgggagagggagagcaccatcaagttcacgctgcccacagaccacgccctgagcccgttaggttttcttttcttggtggtgcaaagtggtataactgtgtgcaaataggaggtttgaggtccaaattcctgggactcaaatgtatgcaagtactattcagaatgatatacacacatatgtgtatatgtatttacatatatt

SEQ ID NO: 361 - DNA, 1524 bp, Homo sapiens
ggcacgagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcggccttggcccgggaatacggtggttccaagcgcaatgctctactgaaatggtgccagaagaagacacaaggttatgcgaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccccaaaaaaaaacaacaaaacacaaaaaataaacatttgttccagggcaacctggaaaaaaaaaaaaaaaaaaaaaaaaaaaaa

SEQ ID NO: 362 - DNA, 1184 bp, Homo sapiens
agcaaaaggtgaagagagaaaggaagctttttctctaaaaatggtgcagctatcctctgaaccaatttccttcggtttaatgtacctgtatcttggggtttttttccacttaatttatcctggagctctttccataacaacacttggaaagcactctcatccttttttcactgctgaacagaattccactgtgtggatggaacatactctatttcaccagtcccctgtagccagtcacttggtttgtttccaatcttttgctttttcagagtaataaccttgtatgtctatcattttgtatgcatacaggtttatatgtaggaaaaattcctagagtaggattgctggaccaatggataaaagtatattgtggacagacaatgccaaattgcctttcagagactgtggccctgtgcaccccatcaggcatgtgtgactaccaaagctcctgtcagctgttttattttatctcctttccagtctcaggctcaatgcagaactttgaggtaagcttttctaaaatgtaggctcctaaacgccacagccagctctgccacatgaaggagagctcaaatgagacagaaacagcctctgggcaggatttctatcctgcacagatatattttccacattctgggaaaccgtgaagcttccagagccacaattccccagaaacacatccccctgctggtacagccaagccccagaacaagctgtgcttgcctggcacctcaaagccaagcaccatggatgccacttgccatgggtgcctgcaatttcaaataatgagaaataagaaatttcagcttctcagtccctctagccaacatttcaggtgcatgacagcctcaggtggcaagcagctactctgccggacagggcagaagatggaacaccccatccctggggaagatcacgaggtcaggagatcaagaccatcctggctaacacagtgaaaccccgtctctactgaaaatacaaaacattagctgggtgtggtggcaggcacctgtagtcccagctactcaggaggctgaggcaggagaatggcgtgaacctgggaggtggaggttgcagtgagccaagattgcgccactgcactccagcctggcaacagagtaagactccatatcaaaaaaaaaaaaaaaaaaaaaaaaaaaaaaaaaaaaaaaaaaaaaaaaaaa

SEQ ID NO: 363 - DNA, 770 bp, Homo sapiens
gctaaaattcaacaaggtgagtggccggcagtggaaggctgttgctcattctgatttctgttggctctatttcatgctaamccagttttttttgtttgtttgtttccactttataacatatggatttctatgccacactacccgtaactttgaaaaataactttaggctgcagttttcagcaaacaggacagtccttagctgccacatagctcaacataaagtgcacaaaaaacttcacggtgggacagtgaatcataaattcccaaactgacgtgtgtctacagaacagatgagaactgttactcagtgtgtatcttaggagcttttctgcagtttcctcacactccgtcacatttaaaatgtggacacttgtttatttcattagggaggaggcgagggactaatgtccaccctgcccagagtatttcgaatatccttagtgaagaggaggaaagcaagaattctgttctaaaggccaccaggctaagcactagaatcgcattctcttcctgtttgtatgtttatgtcagcagttgccacagatgtgttaatattgttttcctggtagagaattaaggtgttcgttcatctcaaaacaaatcccgtaacctgcacacaaaactccagcttcctaatgcaaagagaagagaatattgattataagctgcttgatattctttttattcccagcccctcaaaataccagcctggaagtctggacattactaaaatttaccagtctcaaaaaaaaaaaaaaaaaaaactcgag

SEQ ID NO: 364 - DNA, 617 bp, Homo sapiens
  misc_feature (9)..(9): n equals a,t,g, or c
  misc_feature (513)..(513): n equals a,t,g, or c
  misc_feature (559)..(559): n equals a,t,g, or c
  misc_feature (587)..(587): n equals a,t,g, or c
  misc_feature (602)..(602): n equals a,t,g, or c
atggaaaancaggcaaatcctgaaatgggctggaaaaaagggagggacccagcactyccagggagaaaacttggcattycttgggaatctaacaggatgcagtgaacccaagccttttgaagagctcaccaatcagactgcccttgtctatccatgagcagatgtttgatagtattgcggaggccctctagtgggtatgctgccaagcaactggagtggcacttgggctctaatccagttgtctatccctttcaccctggcatttcatcagccaaacaaaaaccaactaactcagaaaaaaaggaaagcccctcaagggtcctttgaccccgatatctacatagatgctatcggggtcccctgaggggtaccaaacraattcaaagctcgaaatcaaatagctgctggattcaagtctgtccttttcttgtggtctactataaataaaaatgtagactggataaattacatatactataaaaaaaaaaaaaaaaaaaaaactcgagggggggnccggtacccaattcggcctatagtgagtcgtattacaatcatgggncgtcgttttacaaagtcgtgactggggnaaaacctggcgttanccaatttaatcggct

SEQ ID NO: 365 - DNA, 1130 bp, Homo sapiens
ggcacgaggccatttgtataattctttagtaaattgtattaatgggagaatctgtaagttatgtctgaactttcaggttgtcttataattgtctttttccttatgtcagatgttctatgtcataagaataaaatggttcacaccaatacaagtacttagttgtggaaagggagagtagaagataaaaatggagattttcctgtgctacaggcttagtcaagcttatggtctatttaatggttatcaaaggcaattaaatagtgttgaatgttctgcttttacctacatttcatttttcatgtacttagttacaaattgaaccctcttctatttttttcctgctcctgtttctgtttcattttagttttccttttccctgattatcatttaggcatgtaagtgacacccagtagcattgctttaattctgctggtgacagtgccaaagctttactatactctttttgttgtctgttgcttttctcttgctaatttgcttgactagataactaagaattcaggtaagcattagctctttgttcactgagaataatacaacttgcaagataattaatttggattgttctacatgtatttcgtttatttctctttaccttgttcatttattacgacattttgaattatttacatacccatatttcttctttcttttatggctcagctcactatgcttttttttaatactggtagcttcctcaaggttggaaaacaagatctgaatactatagaaaataataactatttttctgtggtcatattaaagatataatggctttggattttggggtgatttttctactgtcagtttaaaaaaaacttgtctatttgcatttgtgtgttattacttctagttaagagtatttccaaggaaagtttcatgttacttattttgtttccatgtctttttccaaaagaacttattttttatattataataaatatcagtggaaaagtaggtttcgttatatagaaattaactttaggctgggtgcagtggctcaagcctatatttgggaggccgaggcaggaggattgcttgaactcaggagttcgaaactagcgtgggcaatgtagcgagacctggtctctacaaaaaaaaaaaaaaaaaaa

SEQ ID NO: 366 - DNA, 3740 bp, Homo sapiens
  misc_feature (957)..(957): n equals a,t,g, or c
actctctaaggcttttttggactcaccaaacaggcttcttgcagtggagatgaatacagatcacttaaggttgactgtgccaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccratgctgaaagacaagcagttacacccccaggattacaggaggcaatcaatgacctggtgaagaagtacaagctttctcgagcttttgtccggccctctggtacagaagatgtcgtccngagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacaaaaaaaaaaaaaaaaaactcgag

SEQ ID NO: 367 - DNA, 2286 bp, Homo sapiens
  misc_feature (2262)..(2262): n equals a,t,g, or c
  misc_feature (2264)..(2264): n equals a,t,g, or c
  misc_feature (2272)..(2272): n equals a,t,g, or c
  misc_feature (2278)..(2279): n equals a,t,g, or c
gctgatgtcgaggttcatcctgaaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccaaaaaatcctctattgtatatttattcaacaactgtttatgtttccaggacaactgcaaagaaaacaagctgaggtggttatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaayggctgtgataagtaggttttgattgagtgaaagcatgagcttgttcagagtgaggggcatagtgaaaaaggaacagccatgcctcawaatcaaatcatttgcrttcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtgaaaaaaaaaaaaaaaaaaaaaaactcgagggggggcncnaaaacaantcgacnnatagtga

SEQ ID NO: 368 - DNA, 1240 bp, Homo sapiens
  misc_feature (1225)..(1225): n equals a,t,g, or c
gtgaaacgcctgggctcaagctgattcacctgcctccacctcccacagtgctgggattacaaacatgatcccccacgcccagccaacacaaaacttctgatgctctgttttctcatctgtgaactggagctaaggctaagtggtctgtctgtttaataagagtttgaatcagatggcctggcatgaagagtcactggcctgagagaatgtcaggggcatttgtaaatgtgtaaagggctgaaaaatcctgagggattattattattgctattgttgttattattcacagacacatccaacagccattgtctgcctccttatctgtcatgctttctgcacgagcgtcagcctgagcttcaatctgtgtgtatatctgcagcttacgtccttgccacccctccagaacccagtttcatccttgtaggtttttccgaagcaggatttgcacaagtggcgtgttttcttaagtatttattttgcaggccatttactcggcatggctatttttacagtgggtaaggagcaaggctaaaaataacttagctcataaccagacaggttctgcatttgacatttacgtggaattcatttgcatctcatttgttcgcctttctgtttaacaggtagaatgtaagaaagctcagccgaaagaagtcatgttcccacctgggacaagaggccgggcccggggactgccttacaccatggacgcgttcatgcttggcatggggatgctgggtgagtctggacaggaccgcaggtcaccatggactgggagggctatggaggcctctactcccaactgggtcacctaccagtggggcaaactgcttcacctttctaagcctcagtttccttgtctgtagatgaggatgataattccccgttccaagacagttgtgatgattaagtgtgggtgtgtgtgtgtgcatgcatgtgtgtgtgtgtgtgtgtgtttgtatttataatattgccccatgcctggcttataggatatgttagactattttctctcttttccatctccttcctcaaaagaaggaaaagtccccctctattgcctcagccctctcatctgagtgggagttcttaagatgtaaggactcctggctgacttgacttgtgtgggctaaggctacgttttctaaaactkgggagaggagggaagtggtaagggtgggcgataatcctgtctatttaaatgattaacatttttctcttgggntatcaaaatttgcat

SEQ ID NO: 369 - DNA, 997 bp, Homo sapiens
  misc_feature (963)..(963): n equals a,t,g, or c
cccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttytytatatcacctttytggaaatcctgctntttcatcccaaatttaagggggtttcaagaagaa

SEQ ID NO: 370 - DNA, 1770 bp, Homo sapiens
gctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcaggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgaagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaacgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaa

SEQ ID NO: 371 - DNA, 1167 bp, Homo sapiens
  misc_feature (432)..(432): n equals a,t,g, or c
gggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaangaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaraaaactggagaaacaaatatcctgccacctctaacaagtacatgagtacttgatttttatggtataagcagagccttttcttcctcttcttgatagatgaggccatggtgtaaatggaagtttcagagaggacaaaataaaacggaattccatttttctctcactgtaaaaaaaaaaaaaaaaagggcggccgc

SEQ ID NO: 372 - DNA, 1618 bp, Homo sapiens
ccacgcgtccgcaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcgactgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttcccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagtcgagggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggaaaaaaaaaaaaaaaaa

SEQ ID NO: 373 - DNA, 1338 bp, Homo sapiens
cccacgcgtccggttcccccatctgtctctcaggagcgagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcaccgtggatgctgctatccgggtatgggatgtctcaacagagacctgtgtcccccttccctggtttcgaggaggtggggtgaccaactgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatcttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccaaaaaaaaaaaaaaaaaaaaaaaaaaaaaaaaaaaaaaaaaaaa

SEQ ID NO: 374 - DNA, 1892 bp, Homo sapiens
ccacgcgtccgcgggaccggacggatcttctccggccatgaggaagccagccgctggcttccttccctcactcctgaaggtgctgctcctgcctctggcacctgccgcagcccaggattcgactcaggcctccactccaggcagccctctctctcctaccgaatacgaacgcttcttcgcactgctgactccaacctggaaggcagagactacctgccgtctccgtgcaacccacggctgccggaatcccacactcgtccagctggaccaatatgaaaaccacggcttagtgcccgatggtgctgtctgctccaacctcccttatgcctcctggtttgagtctttctgccagttcactcactaccgttgctccaaccacgtctactatgccaagagagtcctgtgttcccagccagtctctattctctcacctaacactctcaaggagatagaagcttcagctgaagtctcacccaccacgatgacctcccccatctcaccccacttcacagtgacagaacgccagaccttccagccctggcctgagaggctcagcaacaacgtggaagagctcctacaatcctccttgtccctgggaagccaggagcaagcgccagagcacaagcaggagcaaggagtggagcacaggcaggagccgacacaagaacacaagcaggaagaggggcagaaacaggaagagcaagaagaggaacaggaagaggagggaaagcaggaagaaggacaggggactaaggagggacgggaggctgtgtctcagctgcagacagactcagagcccaagtttcactctgaatctctatcttctaacccttcctcttttgctccccgggtacgagaagtagagtctactcctatgataatggagaacatccaggagctcattcgatcagcccaggaaatagatgaaatgaatgaaatatatgatgagaactcctactggagaaaccaaaaccctggcagcctcctgcagctgccccacacagagccttgctggtgctgtgctattcgatcgtggagaatacctgcatcataacccccacagccaaggcctggaagtacatggaggaggagatccttggtttcgggaagtcggtctgtgacagccttgggcggcgacacatgtctacctgtgccctctgtgacttctgctccttgaagctggagcagtgccactcagaggccagcctgcagcggcaacaatgcgacacctcccacaagactccctttgcagccccttgcttgcctcccagagcctgtccatcggcaaccaggtagggtccccagaatcaggccgcttttacgggctggatttgtacggtgggctccacatggacttctggtgtgcccggcttgccacgaaaggctgtgaagatgtccgagtctctgggtggctccagactgagttccttagcttccaggatggggattccctaccaagatttgtgacacagactatatccagtacccaaactactgttccttcaaaagccagcagtgtctgatgagaaaccgcaatcggaaggtgtcccgcatgagatgtctgcagaatgagacttacagtgcgctgagccctggcaaaagtgaggacgttgtgcttcgatggagccaggagttcagcaccttgactctaggccagttcggatgagctggcgtctattctgcccacaccccagcccaacctgcccacgttctctattgttttgagaccccattgctttcaggctgccccttctgggtctgttactcggcccctactcacatttccttgggttggagcaacagtcccagagagggccatggtgggagtgcgccctccttaaaagatgactttacataaaatgttgatcttcaaaaaaaaaaaaaaaaaaaaa

SEQ ID NO: 375 - DNA, 813 bp, Homo sapiens
gaagaaggtacgctgcaggtaccggtccggaattcccgggtcgacccacgcgtccgccaaaagcagacatagcttcagatgcagcttgatccagggctcagatgccatgatcagaatccaattcttgcatctgtttctttgggttggcttcattttcaggcagcccccttcctcatatcctcaagatggcagagacagcccatggtctttcccttgcagagacagatcaccaggaaacaatacctctatccctagccatgaaacagtcttgaactttattctgacttgatcagccaagtccctgttggaaccatcactgcctagcttaggcctgagacagtgctgcacctctactaccaaaggccgggctggccttccctaaagtgtatgtgctgcgtgggggagaggtacggatctgaaccaaaacgagggctgtccagcgtcagcaaatatctcccgcagtcccagtgcctccagcaggaggcaaagcatcaacccctccgtctggctcctctactgaaaattccctcagcagcctcacaggccttaggcttgtcttagctacttcttcatctacttttttgctttcttaattatttttcttttcttttttcttattttattttattttattttagatggagtttcgctccgtcgcccaggctgaagtgcagtggcgtgatcttggctcgttgcaacctccacctcccgggttcaggagaatcgcttgagccccaggaggcggaggttgtgggaagccaagatcgcaccactgcactccagcctgggcaacaagagcagaacgccatctca

SEQ ID NO: 376 - DNA, 1038 bp, Homo sapiens
ccacgcgtccgagacatttaaactagattcccagtcctctccttcaaaagcttggtctttgtttttcctatagggaaaaaagtcaaaataagttccaaaaactatcctcaaagtagtattgtgcttgtagtaaatgaaggttggatggatggatactgacaatggtggcaggcatttcaagccttttaaattagtactttttgtcgtcttgcttattaaaattttgttaattttagcaaagaccaattgttgtgataaactggtgttttttggatgcttcaagcacacgttaaccaattttttaattccccttttggttcctcccattgttctaaaataggactttcatattattaaaacctcaaaagatgatccacccaggatgaacaaagatcaccaaggggaaagaaaacattttttatctttacagaaaacatgttaagattatatatagatgtattctttacattggatattgtattagagtcctccttacaagaaatgaaatagtttttagcactcttagcattagagttcctagattggtgttgatagctacagttttaaaatgtataacctgaaaatgaaggttaattttgcattgtaagagcacatttgatctatgtaaaaagtgtccatttggtgtatttttttaaaaaagagaaagcactttcatattaagtagcatgtgtatgaatttagattttcatatttgttgtgtctgtattcagtgaagtaaattgagcatttaaatgtttgttgatggcaacattaactattaaattaaagcaccttatactctgctgcttaacttgcttgtaattgcacctttgttacctgcacattttcatatagaatattgttgtaacattgcttcatgtgggtctggatggaagattagtgggcctacaggatcatttatttatattgtttatattacaataatatattgtagatcagttgtaagttcatttctttacaaataaaagcctcttccatttgaaaaaaaaaaaaaaaaaaaaaaaaaaaaaaaaaaaa

SEQ ID NO: 377 - DNA, 2383 bp, Homo sapiens
  misc_feature (538)..(538): n equals a,t,g, or c
gagcccacgagaggcagcgccatggcggagcagacctactcgtgggcctattccctggtggattccagtcaagtgtctacatttctgatttccattcttcttatagtctatggtagtttyaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcntctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatrggggactcagtttcagagaactgagacagaagctcttctgtcgttatattcttctttcctttttttggatttattaaatattttctgtggtgtgaagtgacttattaaatccacagacattgagtgacttcttacaacatccacataagratttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttgacattttgtttcattggtgtgctgtatattttccatgccctcactcctttaagaaaaaaaaaaaaaaaggaaaaaagcaacac

SEQ ID NO: 378 - DNA, 2081 bp, Homo sapiens
  misc_feature (538)..(538): n equals a,t,g, or c
gggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcacttacactgcttgctttggtttactccctggtgttattgctgccattctacaactgtaccgaggncacaaaataccgtcgattcccagactggcttgaccactggatgctttgccgaaagcagcttggcttggtagctctgggatttgccttccttcawgtcctctmcmcacttgtgattcctattcgatattatgtacgatgragattgggaaacttaaccgttacccagscaatactcaagaaggagaatccatttagcacytcytcagcctggctcagtgattcatatgtggctttgggaatacttgggttttttctgtttgtactcttgggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgcagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaaaaaaaaaaaaaaaagggcggccgc

SEQ ID NO: 379 - DNA, 646 bp, Homo sapiens
tcgacccacgcgtccgataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggttttttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaawraaaaaaaaaaaaaaaaaaaaagggcggcc

SEQ ID NO: 380 - DNA, 312 bp, Homo sapiens
aattcccgggtcgacccacgcgtccgtgatgagtggatttgtactcttacccaggtcctgagggccagcccacccagcatccccacccctgatgacgctgtccctacaactggctgaactggtgcattttgtgtgtgccttccagagccagtggactggtgtgtatccaatgatgccacctctgaaacctacagaaccactatgctttgcatgtgtaccctgcagggtctgagggccaggctgtctggtagctctgctcctgggtgacagagcaagactctgtctcaaaaaaaaaaaaaaagggcggccgct

SEQ ID NO: 381 - DNA, 826 bp, Homo sapiens
  misc_feature (726)..(726): n equals a,t,g, or c
ggtcgacccacgcgtccggctccctttgttttggtggcagccttcttgtgctgtatacttgttccctagggtgtataataatatgtgcactagagtgctaggtaccctaccacattgctgggaccttgccacactgctgcagccttccagtaggatatgggggaatgtcagtgaggctccagggatgtagatatgtagggaatgttggaccccagggcaacatgcaatctggtaggagttgggctctcaaaatggtgctgctgtgtaacagctgcttgggtcttggggtagggagtgtaggacccagcatgagctccctctttggagcagtgctgtctgagactccaggcagctccgtgtattagtctcaggacctgcaaaggcctaggggctctttttgggtaggactgcaggagtctccatggtgggaatgtgaaccactggaaatctctcatttaccatttccctgtactggagatgctttctgggctcccagatgatactarctgggctggttgcctcamttccttctccctctgtgcataaggcattttctgtcacttctctgctgaactctagtgttctttcttagaggctgtactcaaagtttcattatccattcagtatttttattcttctttgtggaggtggcaagtgctaggtgcctctagtcaatcatcttgaagccccctgttatgttaaagtctttaatggaaaaagaagacnacatgcatgaccaggcagatactttgagcagagtcataggaactgctaaaaaaaaaaaaaaaaaaaaaaaaaaaaaaaaaaaaaaaaaaaaagggcggcc

SEQ ID NO: 382 - DNA, 770 bp, Homo sapiens
  misc_feature (770)..(770): n equals a,t,g, or c
atgtgctgggctcaggaaaagttcaacccatcaataggttatcacatatatatactctgggactgattggaccacattttctcactgaattgactgattgatgaattcagttggcagaattaactcttctatgtctacatgaagtgccatttagaaataatcaactcttaatcagcctgggatagtcagtactaaaagcaccttcatgagctgtgaaaaatttaatgcatttatttacatatttagttttaaattttagtatattgttagttgaggtatagtttccaaacaaagagccgtgaaatgtttagtaactgtctctgtacctctggatgaggacagctcagccgggaatggagggggactgggtgaggagaccagaatgtcagtgtggccacgcagcacacttttgttttgtcttctgtccttgagcactggcttgttcctggataaactaggcataataatacctatcctgctgtgtgggtggaaggttaaatgtgataatgatgtgtgtgagatgcctgcacagtgcctggaggtattgaagaattatttgctgccttttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcacatagcctgatttctttcaatctgcn

SEQ ID NO: 383 - DNA, 1276 bp, Homo sapiens
tcgacccacgcgtccgcccacgcgtccgcttaatatctgtattcccagttgcctacgggataaaagcccaaactccttagcagagaatataaggccctagctcccacattatttcagcagtcatcacccactatgttcctcaagactgcagccattaactttttagagttccctaaacatgctgtttactttcatgcctctatcccgttgtctgtggaatgacttccctccttgcccttttcagtgctacaaacccctattctttaagacatagtacaaatggcatctcctggttggcatctttcctgcaggcctacaggcctagtaagtatcttcctcctctgtgctcctgcatacctccattcctttgttatgacatctataactttaataagtactaaaatctgtagtcctacaaaactcaggcatagaactcatttcctttatggytctataatggaactttacccaactctcacgttccccatgaccacagatgtggaaaatttgaatcttgacagttcaaggtgaactcagtcattttcagagttttcatagtcccttcaagattgaaactcagttcctgcaatgtttgccccttttctcctcttttgtctatgctgggagaggcattgtggggagggttgtctggcttatggctcccattgtcctctgcttgataaaccacctgagctttggtcattagcagtctcctgtgcctttcacactcaggtagtgtctgcacaggccactctatgtcttttccatgctgaagaaattcctttccaggccatgtctgtgttcctcctgccacacaggaaatttttgagcatgttcatcctccaagctgaatgcagggtcttgggtagtggtcctcacctgctccagagacttctccagccattgccactctccactcaggtgatgaagctggatgagggactgcacccaccagagtcaggccagggtcctgtctgctctgtgagtccctccaattgttcttattccgagatttccattgttctgccccctcttgactcccagggctctcaagggagtgggggtagtgaagggagccctttcccaagctcccccaagagctctagtcacatcacttctgatacttcttttcccaccagctggaagaaagaactttcatttgtcttgaaatgagaaaaatgttcttagaatattttgtattactctctgctctgtcatttatggtaaacaaaataaaataataaaaaaaaaaaaaaaaaaaaaaaaaagggcggcc

SEQ ID NO: 384 - DNA, 1045 bp, Homo sapiens
tcgacccacgcgtccgagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagcyttttgtgctggtgaagtttgtttcctttaacttatcctccaagagtaccgaggcaccgagatctaccatttgccacctcatccatttctatggcagaacaccgcctggggagaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaagggcggccgctctagtaggataccaagtctttacgt

SEQ ID NO: 385 - DNA, 1223 bp, Homo sapiens
gctgctccgtttttcccccatctttgtggttttatctacctttggtctttgatgatggtgatgtacagatggggttttggtgtggatgtcctttctgtttgttagttttccttctaacagtcaggacccgcagcttcargtctgttggagtttgctggaggtccactccagaccctctttgcctgggtatcagcagcagaagctgcagaacagcggatattggtgaacagcagatgttgctgcctgatcgttcctctggaagttttgtctcggagtacccagccatgtgaggtgtcagtctacccctactgggggatgcctcccagttaggctacttgggagtcagggacgcacttgaggaggcactctgtctgttctcagatgtccagctgtgtgctggtagaaccagtgctctyttcaaggctktcagacagggacgtttaagtctgcagaggattctgctgccttttgtttggctgtgccctgccccccagaggtggagtctacagaggcaggcaggcctccttgaattgcggtgggctccaccgagttcgagtttcctggccgctttgtttaccccctcaagcctcggcaatggtgggcgcccctcccccagcctcactgccgscttgcagtttgatctcagactgctgtgctagcaatgaktraggctctgtgggtgtagraccctctgagccaggcatgggatataatctcctggtgtgcgatttgctaagacccattggaaaagcgtagtattagggtgggaatgacccaattttccaggtgccgtctgtcacccctttctttgactaggaaagggaattccctgacccgttgtgcttcccgggtgaggcaatgcctcgccctgcttcagctcaagcttggtgcgctgcacccactgtcttgcacccactttccaacactccctagtgagatgaacccggtacctcagttggaaatgcagaaatcacacgtcttctgcgtcctcacgctgggagctgtagactggagctgttcctattcggccatcttggctccacctgtcgagatattttacattaactttctatgacatacttatagcaaaacttattttttcatgcagaatagtctatattctatatttattgtaaagcatataccgtacatggtgactagtcaccatgctgtacaataaattttctgaacttaataaaaaaaaaawaaaaaagggcggccgc

SEQ ID NO: 386 - DNA, 864 bp, Homo sapiens
ggcacgagcggaccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggcctttgatcctgggctgctggtgctacctgcggctgcagcgcatcagccagtcagaggacgaggagagcatcgtgggggatggggagaccaaggaacccttcctgctggtgcagtattcggccaarggaccgtgcgtggagagaaaggccaagctgatkamtcccaaacggsccggaartycacggstgavccaggatgcaaaggccycctggtccctgtttgcaagccggccaagarggggctgggaggggcaaaamccatacggatgcgctgctgtctgagaggaagggctgacacttgctggcatggcctctgcgggtttcgtccatcgcatgcactgatgcccggggacttggctgtcctgggcttcccctcggcctccaggtgaggctgcccattgcaggcactgggtaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcaaaaaaaaaaaaaaaaaaaaaaaaaaaaaaaaaaaaaa

SEQ ID NO: 387 - DNA, 1267 bp, Homo sapiens
ggcacgagctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcagctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtcaaaaaaaaaaaaaaaaaaaaaaa

SEQ ID NO: 388 - DNA, 3194 bp, Homo sapiens
cacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcacctcgtgc

SEQ ID NO: 389 - DNA, 1258 bp, Homo sapiens
  misc_feature (1)..(1): n equals a,t,g, or c
  misc_feature (1196)..(1196): n equals a,t,g, or c
  misc_feature (1200)..(1200): n equals a,t,g, or c
  misc_feature (1237)..(1237): n equals a,t,g, or c
nagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccgtagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtgcccgagactctggacggactgttncttnaggaatttaaccggatgggaagttttttaaacttttncaaccaacttttttaaggccc

SEQ ID NO: 390 - DNA, 883 bp, Homo sapiens
  misc_feature (19)..(19): n equals a,t,g, or c
gtcaccgtgggcgtttaantatgatccccggctcagattcgcagactgcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccktcctctcttcttcaaaaaaaaaaaaaaaaaaaaactcgag

SEQ ID NO: 391 - DNA, 1465 bp, Homo sapiens
ggcacgagcgagccaagtttgcaccactgcactccagcctgggcgacagagcaagactcagtctcgaaaaaaaaaaagttggaagcagaagtaaaaaacatggtaaagaatgagaactaaataaatataataattgagaggtctgcattagatgtggcagggagaacaagcaaaaagagatttcagagaagatcactggaattggcagaggccttgaagggcagagtctagcatacagaagatgtaaagccacattctgtgaaggtaagtagatgtgtttacctcttttgcactgtactggtgcattatggggtaaatrtgtattacttttcctgtattgcttagcacagagttttgcctatagcaggcaccagactgtgggcttggtagtacatgactattggtgattacagatcaaaaaggacttgaaatgatcagtttaaggtcttgatgggtattgaagactcaaaggatgatggcaccctgggagtgatccacagaaggacagattatttgaagatgttaataactaaagacaacatggatgttaaatgatgaaaaaaagttggatggaaaataaaccattggatctgcytctggagtccaagaagaatattattcttcctacctcccccttactctggctcttcctattgtagccacatgggtcagtaatgccattgaaaaacaaaattttagactaagtggggtcgcagaaattttggtctatcttaaattgatgacatcttattaaagaatytattgtataaagtgtgcttattctggcatttttttaatgaagaaaaagtgtaattcagtgcacatttatgaatttcaaagatcaataaaaatgggcaaagtatatgaacgcataatccatagaagaagatatctgacaaatgcagttcaataaatatttttttaaataaaaattagcctgtggtaagaattgaaatggagaaagaaatagaaggtagccaggttacctacagctttgtatatgacactatagagctaggactttattccatagatgagggaagtctgctaaagtgtctacattgaacccattattttgctagcattgtagttgatgtacctaaaacagacttgagccggtagagtaagtaggcagacttgtccaagtgagaaaaagatgaaactgtggtgaggataaagagagaaaaggagcagatttaagaaatattaaaacttgaaagtactaagacttgatgatgaactagatgtgttagataagagatagcatggagtctagtaaaagttctgtttttctcactcgtgtgactgcctcaataacacaaagcttgataggaaataaacatgagatagcacatggatctattacaagtttttgaaattgagcttgaaaagctacttcaaaaaataaattctaggccaggtgtgagyccatgcgcttgattaaaaaaaaaaaaaaaaactcgta

SEQ ID NO: 392 - DNA, 698 bp, Homo sapiens
gtctagtttatgtttttccactggacagggagctccttgaggaccttgtcttgctcgctgcccccaccctaaaacttgctgtaaagcagttcctggaacagagcaggtgctcagtagtactggttgcatgaatgaatgaatgaatgaataggttttcctcttttagacacattgggagatgggcctatggtttcctatgctcattttgacccagagatttgtgtcctgtgactcacatccagacccaaaacacacacatacacacgcacacataaatacacacacacacagacacgtgcacacacagacacacatgcacacacacatacacacaccttggtttgaagagaagagggatgggaacagacattctacgcatgcctacagtgcaccactgtgcataggtaactgatgctgtataagcactcaaggattatctccatttttagccagagaaactgaggcttgctttctgctgtgtctccagtgcctagcactgtgcctggcataaacatctgctgaactgaattgcactagattcaagaggctcagaaaacagttcaaggtcacccaactagcaagttgtggagccagaatctgtgctcagggctgttcagtccccagccagtgccgggtagcagccataggcacctgcacaaactccagcgacctcgttaacttccaaacacggtctcgta

SEQ ID NO: 393 - DNA, 996 bp, Homo sapiens
  misc_feature (834)..(834): n equals a,t,g, or c
  misc_feature (996)..(996): n equals a,t,g, or c
gaattcggcagagggaatctgggctctgtggaagaatagcacttatctggattctggccttgtgccatgaacctaaagcacatccgtttggtctgccagtaggctggtatggcatgctgtaacccctataaatattatttctatttatcctgctcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccattacatgcgaaacctgtggaaaatcattcaaacgcatatgtcactcaaggtgcactccktgcagcattctrgagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtggaatgtgccacctgctgtccagatcccacttacaacttccccagccaccccagttccttctgtggtgaacacagccacaaccccnaccctccaatcaatatgaatcctgtaagcactcttcccctcgggccatcccccaccccttctcacaccgcacatccacccacaccctcaccacccacaccamcttcccatccctccaktccctcacctcccgccacctccagctctctttaagagtgagccn

SEQ ID NO: 394 - DNA, 1856 bp, Homo sapiens
gaattcggcacgagctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtratttgattatctttctatctcttttatttatttctcatttacttaagaaattcgttccattggttggcattgatacagtaaatttgtaaatgaggagacaatataaaaaatctaaattacttgtgcttaatgactgtagcagaatsccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggtgtagttgctagtgtgtggaggtgcagagaggttggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgttagtcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctyttctctctagaaaagataacaccrcaattaataatccttcccactttcattgagatcagcttgtctgataacctgatatgagtgtgataatgataaacatgataatagtggtacttttgtaattttgctggtgcatttaagaagatagtaaakgatgagttcaycttttctycgaacatycctatycctagatgtagtttacctcaaattgggaattataactgtcctaatttttgttgtgtaccctgatgccccttttgctttaatacccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaaaaaaaaaaaaaaaa

SEQ ID NO: 395 - DNA, 974 bp, Homo sapiens
caggagtaaagaactttatgagttcatgagaacctaaggctcagtatttgaaaattactgacttatgagaaagcaggcatgtaaataaaaaataaaaaatgttggccctagattttgatatgtgtgtggtgtgtggtgtaggagaggccctgatatttacctgtaagtgttagagttgtatgaaaaaggtggcaagattgagtagcttagggcatgtggtgtggaggctgtatgctagagttttggcattaataacttgtattttctgggttttggcattaataatttgtattttcactccccaaatatttttcaagcatctacttcatgccagaccttgttctagataccggagatacaacagcaaaaatacagatcttgcccttatgaagcttaaattgttgaggcaggcagacagtgataaataaatacatagaatgttgggaaagaaaataagaggatttgagagggtggaatggggaagaaaggattcactgataagatgccattcgagctaagacctgaaaaggtgatctctaaggtgaggaaagagctttctacacagaaggaacagctgggggaagggagcacgcttggaatatttaaggaatatcaaggagggaaaagtggctagagtagaggaagagaatggaagaagtcatgtcaaacaggtactaatggaagaagtcatgtcagacagggtcttgcccattgtaaggactttggccttatacctcagcaagctgagcagccgtcggaatgttttaagcaaaagagtgacaccatctttaaaagggaccccttgtaaggattcagaacagacttggagggaaaacaagtagaagcagcagggggactagttaggaggctgaggtgggaggattgcttgggcctgggaggttgaagctgcagtgagtcatgatcactccactgcactccagcctgggcgacagaaggagaccctgtctcagaaa

SEQ ID NO: 396 - DNA, 413 bp, Homo sapiens
  misc_feature (1)..(1): n equals a,t,g, or c
  misc_feature (248)..(248): n equals a,t,g, or c
  misc_feature (328)..(328): n equals a,t,g, or c
  misc_feature (357)..(357): n equals a,t,g, or c
  misc_feature (372)..(372): n equals a,t,g, or c
nggcccattcgctgttgggtcttctgctagggaggatgtcgggttcgtcgctgcccagggccctggccctctcgctgttgctggtctctggctccctcctcccagggccaggcgccgctcagaacgtgaagagtacaatctggacaggatcagaagtagagaatgaagttgtaaagagaaaggggaaagacagaagaaaggctgcagtagtacaaggagaaaagcaggatgcaagattgaaggaatgnaatctttgtttgaggagcattccggaaaattataagctgttcagaaagggttaattagaccagggaccttttaagttaanttcacactcaaagttaaaataatgttggngattcactcctgtgnaaaattgggttagttttcatttgcccttttaaacaaaactt

SEQ ID NO: 397 - DNA, 1010 bp, Homo sapiens
  misc_feature (607)..(607): n equals a,t,g, or c
ggttacttccaagttctgccaactgtgaataaagttgctataaacatctatgtacaggttttttttgtgtgtggacctaagttttcaactcctttgggtgataccaaggagcacagtcactgggacatatggtaaggatatatttagtttggcaggaaaccaccatactgtcttccaaagtagctgtaccattttgcatacccaccagcactgaatgagagttcctgttgctccacattcttgtcagcatttgatgttgtcagtgttctgaatttaggtagtcatgataggtgtgtaatggtatctcactattattttaatttgcctttctctgatgatgtatgatgttgcagatcttctcatatgcttatgtgacatctgtatatctggtgaaatgtctgctaaggtcttascctattttttaatarggatggttgttttcccattgttgagttttaagagttccttatatattttggatatttaaatatactacaaataaacagtcctttaacagataaatgttttgcaaatattttctcttagtctgtggcttctgtctttattcccttgaaggtgtctgtcacaaagcagtttatcttttttnctttttttttttttttgagacgtagtcttgctccagcctgggtggcagagcgarctacgtctcaagaaacaaaacaaaacaaaaaaacacctcagttgcgcggcaaggtkgctcacgcctgtgatcccatcactttgggaggtcggaggtgggaggtgggagaatcgcttgaggccaggagtccatcctaggtctagcttgaccctatctcaacaacaaaaaaataacaattagcccaccgtggtagtgcatgtctgtagtcctagctactggggaggctgaggtgagaggattgcttgagcccatgagtttgaggttacagtgggctataattacaccactgcactccagtctgagtgacagagcaagaccgtgtctcaaaaaaaaaaaaaaaaaactcgag

SEQ ID NO: 398 - DNA, 1369 bp, Homo sapiens
cccacgcgtccgcccacgcgtccggctggcaagatggcgggaggggtgcgcccgctgmggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggsgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtagagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaaraaaaaaaaaaaaaaaaaaaaaaaaaaaaaaaaggagggggggc

SEQ ID NO: 399 - DNA, 1337 bp, Homo sapiens
  misc_feature (22)..(22): n equals a,t,g, or c
  misc_feature (1318)..(1318): n equals a,t,g, or c
cggggcttcggcgccaggccangcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcraaagactatgawawmawagttttttataccttatttaagagaaacaacctgacgtgcaccawtcagtctgcacatcccaacccttcacattttataaattattgtagatcatgttttgttaggagcccttttatggagaggacattttcccatgncttaagtaatccagccttt

SEQ ID NO: 400 - DNA, 596 bp, Homo sapiens
  misc_feature (4)..(4): n equals a,t,g, or c
  misc_feature (8)..(8): n equals a,t,g, or c
  misc_feature (28)..(28): n equals a,t,g, or c
  misc_feature (57)..(57): n equals a,t,g, or c
  misc_feature (61)..(61): n equals a,t,g, or c
gganaccngctttgccccttggtttccncaaagctcgaatttaccctcactaagggnaccnaaagctggagctcccaccgcgttggcggcccgctctagaactagtggaccccccgggctgcaggaattcggcacgagtcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttgaaaaaaaaaaaaaaaaaaaaaaaaaaactcgta

SEQ ID NO: 401 - DNA, 629 bp, Homo sapiens
ggcacgagaacctttggggctgacacaagatcctttagtgtttgggatgacctctttcctgcagacttcttcccctatccctaactcatgcatggaaaacgtttgtcaggctggtttcccgagcctcctgcacctcaacatcacgctcacccttttgggtttagcccagtgttatttagcaaatttctccagctgcagggaaggatcagagcactatctttttttttttttttttctcctggagccaggactgcacaaggcaatggccaaatttagttgaattcagcctaccatcctttgctgatgactcagctctatgccaagtactggagccacagagatgggtcagtcccagcccctgtcctcaggaagcccatggtcagggaaacgttgtagggataagtaatagagggcagttgccttcagggctcctggtggctgctggtccctatggtgccttgatgtgaattagaagacggtgccctttccaggtggattcagacctacactagaacgcacagctttgggagtgacacacaggttggattttagcaccccttgccccttggccagaggtgccctgctgcacggccatacgctgcagcctcgagggacacacaggccaaagt

SEQ ID NO: 402 - DNA, 1674 bp, Homo sapiens
  misc_feature (1663)..(1663): n equals a,t,g, or c
cccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaatcaaaaaaaaaaaaaaaaaaaaaaaaaaaactcgagggggggcccggtacccaattcgccctatggtgantcgaatgggct

SEQ ID NO: 403 - DNA, 921 bp, Homo sapiens
ggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagttaaaaaaaaaaaaaaaaaaaaaaaaaagggcggccgc

SEQ ID NO: 404 - DNA, 822 bp, Homo sapiens
ccgggttgacccacgcgtccgcggacgcgtgggcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatacatgaagctctctgggcataggtggagtagcagctgtccacaccattgctattcaaagtgtggtttgcacaccagtaatggaaaatcatctgtgcacactgtttagtttaactgatactttttttttcatagcaagatttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccaggcatggtagctcacgactgtaatcccagctctttgggaggctgaggtgggaggattgcttgagctcaggagtttgagaccagcctgggtaacatagggataccttgtccctacttaaaaaaaaaaaaaaaaaaattagctgggtgtggttgtgcacacctgtagttccagctattccaraggctgaggcaggaggataggttgagcatgggargttgaggctgcartgtgccttgatggcgccactgcactccatcctggttgacaaaaaaaaaaaaaaaa

SEQ ID NO: 405 - DNA, 706 bp, Homo sapiens
ggcagaggtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagttcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctyaaaaaaaaaaaaaaaaaaaaaaaaa

SEQ ID NO: 406 - DNA, 1726 bp, Homo sapiens
cgtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacctttgagatcactggcttacagcaatctcaaggtgtttggattttgggcaggggtgctgtgcaggcgttgctgggatctcttcacagcactccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaa

SEQ ID NO: 407 - DNA, 2497 bp, Homo sapiens
ctgagccactgtgcccagcctcggctcaggtttttcaatacagtcttgaccttggcattcagtatcctcacagcatggttctaattaactttctagctctatttcccttttcctgctccctctctctacaactagtctttctctgattgccccgccctcaacccatctaaactagaccccagggaagcaccttggtccccttcctctctcccactcaccatccaaccaatcaccagagcctgtacattctatattttcaacatcgattcaattgtctacttctttctagcctgccctctctgactgggactccttgagccagcctgatcaccccaatccatccctcacactgtgcccatctttctgaagtaggaatctgatcacaccaccctgctaaaaacactctggttctccccacggcatgtggtgcccttgtatagctggcaaagccttgcatggcacggccccagcctgtgcttcaactcaattgcccgactctctccagctctgctgagccacctaagtcacagatggtttctcctctcatctctgctctcttccatgtgccatttctgtggcttggaatgttcttccctcattctctttctggccctttcccgtcacaccttagacgtgcatcttcctctcgaaaacctctagtgaagcctcccagggccaggcagtaccctcctctggcttcttctggatacagaggaagaatctgagcatcgattctccatctcagcaggcctctgtgtgcctgctgactccgactagaccagagatccgtaaggacagggatcgagttttttttcttttaattcactgcctcaaaaatcctctgtgcattacctattcatcctcttctctcccttaacctgaaccagtgatcttactgtctccatcattgtttttttcttttcttttcttttcttttttttttttgaggtggagtctggctcttcacccaggctggagtgcagtgatgcgatctcgactcactgcaacctccatctcctgggttcaagcgattctcctgcctcagcctccccagtagctgggattacaggcatgcgctaccatccccaactaatttttgcctccataattttgccttttctagaatgtcatacaggtggaattactcagtatgctgcctttttcagattggcttctttcacttagtaatatgcttgttttttgagacagggtcttgctctgtcgcccaggctagagtgtggtggtgcgatcttagctcactgaaacctccacctcccaggttcaagtgactctcctgcctcagcctcccgagtagctgggactacaggcacgtgccaccatacccggctaatttgtggatttttagtacagacggggtttcgtcatgttggccagggtgttgttgaattcctgacctcaagtgatccacctgcctcagcctcccaaagtgttgcgattacaggtgtgagccactgcgccaagcctcatttagtaatatgcatttaaactttctccatgtctttaatggcttgatagctcatttatttttatcatggaatatttcattgtctggatggaccacagtttatttctccattcacctactgaaggacatctcggttgcttctaagttttggcaattatgaataaagctgctataaccatcaagtgcaggtttttgtgtggacctattatcaactaattcgggtaaatctcaaggagtgcaattgctggatcacacagtaagagtgtgtttagttttaagtggctgtgccattttgcattcccaccagcaatgaatgagagtttctgttgctccacattctcactaccattcggtgttgtcagtgttttgcattttggccattctagtaggtgtttacatggtatctagtcatttgaatgggcatatgatgtggaacatctttttttttttaattttattattattatactttaagttttagggtacatgtgcacaacgtgcaggtttgttacatatgtatacatgtgccatgttggtgtgctgcacccattaactagtcatttagcattaggtatatctcctaatgctattggaacatcttttcatgtgtttatttgccatctgtatatcttccctgatgagttggggatgcattctttccatctcagagtccccagaaactaacatagcagttggtacagagttggtgctcaacaaacatcagcttaggaactatgtcctatgtttttttgtttttttttttttttaaaaaggaatgtgagctgttcccaaaacgtatgtccttcccccatgcctctaccctgcccttccacaaactttctgatcttcagcacacactacccaaccatcaaggctgagacttcccgtggccagcagtgtctcatgctggcttcaagccccacagcactgcttttttcaacttctcttgtggtttagactgtctttagcccagcaagagaattcgatatcaagcttatcgataccgtcgac

SEQ ID NO: 408 - DNA, 1217 bp, Homo sapiens
tctggaacctctctcttaattcatatttcccgtaagtctgtccatctgttgtgtggaatctcagtttgtgatattggatagatgcaaataagcaaagctgttacttttcatagtttcaaatgaaaaactcaacatcactactgtataaattattttctagtctatctgtgtttatttttaaattccttttactattctatacattgcacattgctctgggggtaaaaatccartataaaccattagctcattttattgaccattcttgtattcagcaagtatcccaagtacagtggtccataccttgaattttttttcactttttaagtgagatataatttacataccataacaacttagtgggtttcagttatttcaaatacaaggttgtwcatatatcatcactgtctaattccagaacattttatttttattttttttcagcagtggggtcctgccatgttgcccaggctggtcttgaactcctgggctcaagtgatcctcctgcctcagtctcccaaagtcctgggattacaggtgtgcgccaccacacccaccctcaaaacatttttatttcctaaaaaagaaaccccacatccataggcagttccacattccgttcttcctatgatccagctcttggcagctactatagttkgtttyctgtttctgtggatttgtctattctggacatagcatgtaattggagtcatacaatatatggctttttgtgcctggcttctttcacttagcataatgtttttaagattcattcatgttgtagcattatcagcactttgtttcttttatggctaaataacactgcattgtgtgsacataccacattttgtttatccgttaatcagttgatggatatttgggttgtttccacttcggggctattatggatgatgcttctctgaatatttgtgtacaagtttttgtgtggacatttgtttttagttcacttgagtatgtacctaggatggaattactgggtcatgtggtaactgttttaatttcgtaggaactgccaaattgtttcctaaagtggctacggtattttacattcccatcagtactgtatgacagttccgtttatccacatccactccaacacttgttgttatctgttttgattatataatagctattttagtgggtatgaagtcgtatttcaaaaaaaaaaggaattcgatatcaagcttatcgatacc

SEQ ID NO: 409 - DNA, 1283 bp, Homo sapiens
  misc_feature (341)..(341): n equals a,t,g, or c
gaattcaaagtttaccaaatgtgcaaaatgagcagttttaccttaggattattatttttatttatatttactactgcagaaaattatttgattctttttcagagaaaatactgtttggttatattttggggggagttttgaatttcacatacgaaagaaataacacagccctttcaaactgcctgtgtttcaacctgcaaagttttttttgtgctaaagatttgagctttgtgaaggattccctttttgttccttcttctccagcaatctcagctacctgggcgctcctgctaatgatttctggggttccgtgccaggggtcggcaggacaagtgtttcanttgaagcttcatttggtttggagtctcttcctcytctgagccwacaaagctcgggtccacgggtactctgscaaaattcatcatcttagttaggcatttggcagaataggtgaggcagggatgaatctttaacaaatgttaatgttgctttgctgggaatgtgcagaggggcatccaagatgagcacacatttaaaagtaaacacatgaataagtggcagtagaatttattttgcaactctgagtgctacagtgtctactgaattcagtgtattccacgttcttattacaactaaagactgggtagaacggacttctcttaactatgcaaagggaaaatccaagacaagattccgcaggctgctggtgaaaaggggtgttatcatgcagatgtcatcctaacagattagcagagggaagtggaaatgttcgaggatgttcaatgccmcgttgttggttwtrgcaaamccactggaaacamcacaggagtctaaaaatagaggcctggtagggaaaatggtacagctacggaatgcaatactattgaagcattagaamcaatgagcttctgacagccccagagagttattcataatgtgtagttaatttaaaaaagaaagtcgagagtcagactctacaagggcataatacgccattttggtaaagaaaatgtgtatgtagatatgtaaatagatttggatacgaattattgtatatacgaaggaagagtgccaaagcctacataccacgcttttaatagtttttaatcttcgttattaaagaaagattgagggagatgggatttctgtttttattttatacaaatctgcattgtttgaattttttttttttttacgacaagctgttatttctctggggagtttaaaaaaaatacaaaaaaaagggaattcgatatcaagcttatcgataccgtcgacctcga

SEQ ID NO: 410 - DNA, 1552 bp, Homo sapiens
  misc_feature (1035)..(1035): n equals a,t,g, or c
ttgcctaaggcccactgtgccaaattagataatacaagaagttcatttacactgtagaccagtgacgtcaatgactgtttgctctgtgataccgtttcaaaaatccaaaatgcagacttttctctgtgccatgcaggatgcagctgtgtgtgatatggtttacagtaatatttctttctcaaagtagcaggcttgttaaggaaaagataagcaacacatctggggaaaagggcaggtggccagcaatcgatgtggtagctctttgcccctctcggacagcaggaattagcttccccaggcattttctgtatgtgagttgtattgtgggatgtacaaatatcatctgttcctttgggtttccaggccagtagctctctattttgggttcaaacatgggttctcaggccgggcgcggtggctcacgcgtgtaatcccggcactttgggaggccaaggcgggcggatcacgaggtcgggagatggagaccatcctggctaacatggtgaaaccccaactctactaaaaatacaaaaaattaggcaggcatggtggcgggtgcctgtgktcccggctactcaggaggctgaggcaggagaatggtgtggacccgggaggttggaggttgcagtaagccgagattgcaccactgcmctccagcctgggcaacagagcgagactccatctcaaaaaacaaacaaacaaacaaacaaaaacatgggttctcaaaaggcatgcccactgtctcccatggagcttgacagcccatgccattagctctcactgttaggtttctggggaaggttcttctacttgattggaaaatttccaaataaatctttccagaagatactatgcacacagctaagtggcctgtctgtggagtaacccttttgtaaacaaacagaaacctaaagcttgatgttttggggggctgcctgtcatctataggttcatttaggtgtatttaggaagaggatccatgaaaccactggtttcctgttacataataatcattaataatgatttaaaatgtgnacattgatttttttraattccraaatacaagcgtatatggtawattaagtcaaatggtatgttcagtgagcgagatggggcttggggcaaaacaatactttgcttccaaagaggatacaactctcaaggagattctttcatcttgcctttaaggtcatttaaactaattcacataatcttcagaaaactaattcacatcatctattcatgtgtaaaatcaaaaggaagactgttttcttagtctctcgttgcctaactggccatttatactactaggttgattaagggatttgcctttttctgctgatatgggaacaaaaagtcttaagcatttttaaaggcaatggaaaattcagccacatgggggaaaattgatattgtcaccattgagttgctctgtttcttggtgaagagtgaatctaatctgatttccttcttcatcagatatgcctctttaacaacaaaaaaaaaaaaaaaggaattcgatatcaagcttatcgataccgtcgacctcgta

SEQ ID NO: 411 - DNA, 1563 bp, Homo sapiens
  misc_feature (14)..(14): n equals a,t,g, or c
aattcggcacgagncagaaacctgcggaaaatggtagcgatggcggctgggccgagtgggtgtctggtgccggcgtttgggctacggttgttgttggcgactgtgcttcaagcggtgtctgcttttggggcagagttttcatcggaggcatgcagagagttaggcttttctagcaacttgctttgcagctcttgtgatcttctcggacagttcaacctgcttcagctggatcctgattgcagaggatgctgtcaggaggaagcacaatttgaaaccaaaaagctgtatgcaggagctattcttgaagtttgtggatgaaaattgggaaggttccctcaagtccaagcttttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatcttgcttaaattttgtcctatccttttgttaccttatcaaatgaaatattacagcacctagaaaataatttagttttgcttgcttccattgatcagtcttttacttgaggcattaaatatctaattaaatcgtgaaatggcagtatagtccatgatatctaaggagttggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttatttatagtttacaatgaatgcactgcataaaaactttgtagcttcattattgtaaaacatattcaagatcctacagtaagagtgaaacattcacaaagatttgcgttaatgaagactacacagaaaacctttctagggatttgtgtggatcagatacatacttggcaaatttttgagttttacattcttacagaaaagtccatttaaaagtgatcatttgtaagaccaaaatataaataaaaagtttcaaaaatctatctgaatttggaattcttctggtttgttctttcatgtttaaaaatgatgtttttcaatgcatttttttcatgtaagccctttttttagccaaaatgtaaaaatggctgtaatatttaaaacttataacatcttattgttggtaatagtgctttatatttgtctgattttatttttcaaagttttttcatttatgaacacattttcattggtatattatttaaggaatatctcttgatatagaatttttatattaaaaatgatttttctttgcttaaaaaaaa

SEQ ID NO: 412 - DNA, 1617 bp, Homo sapiens
cagaaaggccttcaatttgtgtttgtcagatgttcttctgatgggttatgggctttggggaggaagacacagtgtggtgccctcctgaccacctctcatcagaggtacatgatgctggtgtaccttattactggtgatgttaaatttgggctcctggccagggttggttgctgcctcactgttcctactgaaaggtgttttttctctttttgtgcagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgtatgacctgccatattcagtaagaactgagattggaatatttaatggtaaggaaaaggcacctgattggccaatgcatttttgctacttgatgatcatatttgtgcactcatgcctgttactaactggccaccctaaccctgcctgcttgcatccctactaatagtgcatgcactgaaggaggactggctttgttgatgcttgctgcaatgattcggaatactaagtgtgtacccagatgtggaacaggtggtcacagggctgtccttgttacttctttaatttccattcttttccatatcaggcaagcttgaggtatagtaggaagaacacacattatggagtcagacctgactgagttagaatttcagctcttggtataacataggctaggcacaacctggctgatctgtaaagtggtgacatctgtctaaattgttgaagatgaaataagagaaagtccaagattattctgttagccagttacagttcttaatatacgcgcaatctcggctcactgcaagctccgcctcccaggttcaagcaattctcctgcctcagcctcctgagtacctgggattataggcgcctgccaccacatctggctattttttttatttttagtagagacggggcttcaccatgttggccaggctggtctcgaactcctgaccttaggtgatccggcctcctcagcctcccaaagtgctgggattataggtgtgagccattgtgcctggcctgctatttatcatttttatctagaagaaaaaaaaa

SEQ ID NO: 413 - DNA, 756 bp, Homo sapiens
  misc_feature (230)..(230): n equals a,t,g, or c
  misc_feature (755)..(755): n equals a,t,g, or c
gaattccaatgtccacaggtgatgggagagatgctgagaaagggtggccagtgagtgaggaggaaaaccagaggagtgtgtatcctgggtaccctgaatgtgatgagcgacaagctgtcccccagcactgtgccattgcttctcccagttctcttcaaagtcaccatcctgcttcagcgtgtgtgcccagaagatagcccttcctcttctgtgcttccagaatccgtagncagggaataggaatacatggacaagtagcatgcagtgcagtgagaatgtataacaacagatgactctggggaccaaaatcaaatggggccagctacaaagagggcaggaaatccccacaggtgattttactgtgaggaattttatgaggttcagcatcatatattgttaggagaaaatgctgttttgataagcagagatatgagaaaagtaaacgggaactatgatttagagatctcatctgrttactttgtcctattcycagtttwattactaaagagcagtaaagccaaggagaaagtagtaaagattagatgaatggttagcatgtgaaacctgaaaggaaccagagtgatttccctcgaggaacaaatgcacttctcttacatatgaaagatgatgtgttctgtgttcccatagaatctagggaaagaaaaagtgagcagatactctgatatgagcaatataacttaggtgtaaaaaaaaaaggaattcgatatcaagcttatcgataccgtcgacctcgna

SEQ ID NO: 414 - DNA, 1402 bp, Homo sapiens
ccagtgtcggtctatccaaaaaatgtactaacagatatgtaaaccctgatgaatacagtatgtgttatgagaagtggcccaacgaagcagctcatccaagtgagattctgaagttgggctggcgagtacacgaatggctttcttactagagagaagtgggaccctgctaatctgtagcatgtggtggcatcatggttactcaaatatcactggaacagaaggtgaaagaagaaatctgaagagaaataaaacaaattttcggcggttccaagatggccgaataggaacagctccagtctacagctcccagtgtgagagatgcagaagatgggtgatttctgcatttccaactgagcaaacggcacaccagaagattatatcccatgcctggctgggagggtcccatgcccacggagcctcgctcattgctagcacagcagtctgagatccatctgcaaggtggcagtgaggctgggggaggggcacccaccattgctgaggcttgagtaggtaaacgaagcagccaggaagctcgaactgggtggagcccaccgcagctcaaggaggcctgcctacctctgtagactccacctctcggggcagggcatagccaaacaaaaggcagcagaaacctctgcagacttaaatgtccctgtctgacagctttgaagtgagtagtggatctcccagcacggagtttgagatctgagaacggacagactgccccctcaagtgggtccctgacccctgagtagcctaactgggaggcaccctccagtaggggcagactgacacctcacacagctgggtacccctctgagatgaagcttccagaggaacaatcaggcagcaacatttgctgttcagcaatatttgctgttctgcagcctctgctgctgatacccaggcaaacagggtctgcagtggacctccagcaaactccaacagactggcagctaagggtcctgactgttagaagaaaactaacaaacagaaaggacatccacaccaaaaccccatctgtaagtcaccatcatcaaagaccaaaggtagataaaaccacaaagatggggaaaaaacagagcagaaaagctgaaaactctaaaaatcagagcacctctccccctccaaaggaacacagctcctcgccagcaacggaacaaagctggatggagaatgactttgacgagttgagagaagaaggcttcagaagatcaaacttctccaagctaaaggaggaagttcgaacccatcgcaaagaagctaaaaaccctgaaaaaagattagacgaatggctaactagaataaccaatatagagaagtccttaaatgacctgatggagctgaaaaacatggcgcgagaactacatgacaaatgcacaagcttatcgataccgtcgac

SEQ ID NO: 415 - DNA, 2270 bp, Homo sapiens
ttttttttttaactttttaaacaatccattttaatcatctaaattatttacaatacaataacatggattcatcctttttaagacatgggattgtaaaaatcaacaagtgaatgatgcttcaaataatacatttaaatacattaatcaaattttttcagtgcttaaaactttttctccatgggacagcaggctctggacaaaagtgcctagcatacaagttttcccaatttccttctatcataccagctgcacataaaaaggttcatcacctcctgtctccaaagtgtctccctactgagtgttcccaggcagacaatagttcctgggatagtgctgtttggtaacagaaaagcccaagcgtagaggacggattaaaaggcagggaccagaccgccatggatacaaatcccaagacagaggatgccccatgccttccccatgaagcttatctgtctgcctgtgtctccatgattgcaggcatagagctacttgggacctccaggatgatttacttagcgatatgctttttacattctaagaatcaaaatggtcctgtaattcccaatagagaaaatagagccaattcattgttctcccctctcccctctgaagccagtttttaaagatgagccttacccagaaaataagccccaaagaactctcatctaaatgatcagacccttcctaaattacctttggcaacctaggtaattcttttttattacacacctccaacctgaccctttctacagtttcaactataaatgttcatgcccctcrtcaaataacgttgctaggatgaatttgccacaggtttgagtacagagagaacaagcaagaaaaatgtcagtgtttattttaaggagagtggccaggatgtcagtcctcataattggtcccttctctctctctatcctccaaggtaagttctttgttgacttgataagctttagtccttctgtacaacttctagaagatgcacttaatggtgcttctttgcacttccagaactcaccttctattctacctgtaaggctgtaggggagcatcccaatcaacataaggcctacccctttagccacgaaaatcagccaggcatcatgtttctgcaccaccacctgccttcctgacggacactggtgctgatgacaaaaatgggacagtaccgcagctggtttctctttttcgagtgtgtagataagaaataaaaaacattttcattccctcacaagcttaatctagtaatataactgcctaaaaaaaatcaaaccataaataaacctatgtgctaaacaaatcacatgacttgatgacttctctaaaattaatgtcaaggaaaaaaggaaaagttgatcccaagtaaaatcccttgaccacagctgtctgaaattagccaggggaatgggagacaccaccaagaacctcagctctttcctgccctgtatttcaaggggagtgttgtggccttcacaaatgaaaattatgaatcacaaagataaacgtcctcacttctaacctggtgaatcctcaggaatgtcatgaggatgacaacacagggttaattcattttttctcagtctcccccctgactccacaaaagctttgccttcccaacacaaggggctgggaggtccagtctagacagagcatgctgttggggtaaacagtaaccatgtgatcccatgattcccagagctctgagcacaaagcttttcatcccagtggcaactggaatgtgggtaattctgtaaactcatggccacacctttaatgcttggggacagtgggtggagtcagccagagctcttttccaacttcatctagggtcttctctctggaaaagcttagtgacgttctccgaaggtttatttggttaaggagtattgctaaaacactttttaaaaatccactttgaacacatgtgtaagctgaaaagaaaatgacatatatacctccattgaagctgggaaagtgaaaaggctgacgaaatgtctgaaatcctgagcctttcctggttctattttaatacagcgtacaggtaacagatgatctcatttaccttctgaatgacccagcactcaatttccctaaaactgctcagctccacttggaaatcaccaggggacttgagaatcttccccttagactcagggagacacccagaccaggaagaagggcactgatgttttcagggacccaaaagcccacttttttttttttttttttttttggaattcgatatcaagcttatcgataccgtcgacctcgag

SEQ ID NO: 416 - DNA, 1123 bp, Homo sapiens
  misc_feature (213)..(213): n equals a,t,g, or c
caaaaataataatagtcatcacatttgtatagcactgggtcatttttcccaagaccatttagttacttgacctcagctgttgtccagcttccagtcttggggtaatggcagcttaataatctgaaaattgccaagagaaagatgtggaaggatgaaatggaggcaacatgaatttctgtcaccttgtcatatgttctcatttccakgccttgngagcaagagagttaggtatatcttctgtaactcagacaattttcttcctctttgcagaatggcccctaggaatcaaggtagcttttcttttggaaacttcatgctgtttttagtgttgatagaaaggaggtatctgccatttctgtcacctattttattttgttgtagcacccataatagatcagctgtcacagccacaaatctctgaggagactggaatcattcccagataaatcagaaagtcagaatcactttatggttatagtcctggcttcttgagagcttgtctggaggttgtagcaggggagcacagctagtcatataccctwgactarsgaccggtctwcctctattggggatggttgtcctcttctactgagcttgcagctttgggagggacgcacatggagtggtgagggaggaaggggacacccgcctagccagccagatcagctgaatcaaccctggcaatcaatggggtgacagatgttgcagccagatcgccctcacatccagtcctaccttcttggtaacaaaacaattggttttgctggtctagaaactgtagggctagacatgtattataggactggcttagggagagttactttatattagcactcatgttttcactcatttatttcttgtagctcattaaaagaaaaaccataattgagcatctactatatgccatgcattgtgctgagtatccatgatgctcaggtgaacgggacatggtcctgtaaaaagtgtaaagtctgctgggaaagttagtgctcaaaagtgtaactaaatacttgaggcaagtgctttactagggaataaactaaatatcaagagaacaaagataagcaattccttcacgatgttttacatggtaaatccatacaattttaaaaaaaaaaaaaaa

SEQ ID NO: 417 - DNA, 1417 bp, Homo sapiens
tttttttttgattaaaaaaatttaaaaaattataaaatgatgtcctatatgagtttaatacatgacgttggaggagcatagagatagacctagactaggcatgtgtatgtgtgtgtgtgcatgtgtgtatgcatgcatgcttatgcatgtgtgtgtgcatgcatgcttgtgtgtgtgtgtgtgtgtgtgtgtagagccttggtcatcccgacagagcaaagacacaggagggtggcacatggaagaacaagtgactccaccctcccttgcacagttaaaatctggccaagtgagaggggagatgggagaggggagaggggagaaaggagaagaggcactgactggaggggctgaagctttgtccctcctgggcaggcgttctccatccacacccctcttcttggatagagaggataagcaggccaaagatgcacgaaacctgagttccactgtagctccagacttctagaaaagtcaacagcccctgtatctctagctgatcctctgttgttcaatgtctgcattaccgcactgggagacacttgacagattgggcctgccgcaggccatagcagacattgggcagccctagaacgaagctgactgtccttggaatgtgccacaggggtgtgacgccccggccaactccagtgctgcctaaaatggcctcttgcaacattcccctctcttcatcttaaatcagggacttgaagccacaaaatggcaaatacacagttctggcagtcgttttgagtattggagaaatcgctctggccatctgttttgtctccagcatgtttctcacggaatatccacggatatatccatggatataacagacatcctgccaaggcagagcttggctcttgagaactcggcaagctcagtgcttgcctggattcctgcctcatgtcccatccagtgtttggagaaaagctctgagagaaagatgaatgtctgaggccacacagcctagaagtagtcaagagcacaggctctagaactagccccacgtgggctgaaatcccagcaccagcgcctgccggctgtgtgatgtaggagagcttcttaccagctctgtgcctcacttgtctcacttgtaaaatgagaataagaattggccgggctcggtggctcacgcttgtaattccagcacttcgggaggctgaggtgggcggatcacttgaagtcaggagttcaagaccagtctggccaacgtggtggaaaccccgtctctgccaaaaatacaaaaattagccaggcgtggtggcgggcacctgcagtctcagctactcaaaaggctgaagcaggagaatcgcttgaacctgggaggtggaggctgtcagtgagccaagatcacaccactgcactgcagcctgggtgacagagcaagactctgtctcaaaaaaaaaaaagg

SEQ ID NO: 418 - DNA, 3388 bp, Homo sapiens
cccacgcgtccgcaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactccgagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccagggggtgagcggggcccaccctgcccagctcagggattggcgggcgatgttaccccctcagggattggcgggcggaagtcccgcccctcgccggctgaggggccgccctgagggccagcactggcgtctgcggccgctctagaggatccctcgaggggccc

SEQ ID NO: 419 - DNA, 1965 bp, Homo sapiens
  misc_feature (333)..(333): n equals a,t,g, or c
  misc_feature (1961)..(1961): n equals a,t,g, or c
ggatcctcgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgcatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcancatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcacctttaaaaaaaaaaaaaaaaaaaaaaaaaaaaaaaaaaaaaaaaaaaaaaaaaaaaaaaaaaaanaaaa

SEQ ID NO: 420 - DNA, 1382 bp, Homo sapiens
  misc_feature (1339)..(1339): n equals a,t,g, or c
gctttgttgatgtgccattttagtgctctgtcgttcacattttgtgttttgccactggctttttcgtttctccagaaacattgttacttcactcacaaatttggtcaaaatgtgcaatactcacatttcagagttagttttcaatggaagaaatgagcaaaggtttttattttagttaatatagaaatttgaataattcagagtacagaaaggaacacatttcatgaacatggtgggaatttttcacttaatgtattatattccaccaatatacaaatatttgtatyattttagggcagttagaatagaaaatacattttcagtagaatcgttaataaatgaatagaaaaatgagaactcattggtgaggtagagagcaaacacacactaagggagtgacttgtaattgagcagaaatttcctttgagtttcctaatagccaaagcaaaagaaaaaaaaaaaaggaaggaaacaaacttacaaactcttaccatctaaaaaagaaatcataccattttttaggtggtacaaacatttttctattatcaaactagaggtggcttttaccatgtgaatatttttataaaggctgtggaatgataatgtgaaaattccaggggggaaagtaagcaagaaagtaaagctgcagagctgcatgttgggagtcaggtgacagaggtgaggagttggataggttggtgtctcaggtacttgaatytctggggtggttttcttctgcctagaaaggcttttgggaaagtaaatgtgaagtcacaagtagagaaaggaaacatcagaagagagacagcctgagagtttgcagagctaagatctcaggttaatggttatctgccccagggacaaaggatgttgtacccttttccttaggatttttcttaggcatttaactaatgttcccttgttttacctagccttgtgtcctaccaaactgacatttcaaagagcagcaagtgcctcttggagaacactgggtggcttaaacaggatgcaataataatactcttaaacggtgtacattttttaaaatgtctttttgtatataakwwaaatataagagctgtagcttagctcactaattgccttcctttttgcagaaaatgtgttggtgtattcagaagcagatctttcttacaaggacagattgtttaaagctaactagtattgtagtcaacgcttacccaagggcagaatagagctgatcagaagcaaatcttgaattcaattcgtatttatattttcaggaactctaaaattaattgatctttctgttctgcccttctgtcgtaactgccacagctccagctctgggcgacagagncaagactccgtctcaaaaaaaaaaaaaaaaaaagggcggccgc

SEQ ID NO: 421 - DNA, 529 bp, Homo sapiens
acgcgtccgattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttgaaaaaaaaaaaaaaaaaaaa

SEQ ID NO: 422 - DNA, 1146 bp, Homo sapiens
cccgtccacaatgcagcagactcttcccaaggccacctagcaagcaaggttgatcggatcatctaaactggccgcctcctgaatatttcactgaatcctggcgttcatgttgaagcagacaaaatgagaaaggaggagggcattgctcacctctcaatagcttttttcgttcaagttctatgtctttatcagctcttgcctgtgattttaccccaattcaaccttgggagtgggaagaatatgaacagataacccttggcctaacagctccatcaaacctccttgagagcaactacctaggccaggctagtgagtgctttgtgaggaagctggtcagaaggttccctcaactccttcctggtcctcctggacactgcagaaaagacttaggggatccccagcagaggccaattgctctccttccttccctgccccaccaggaaaggaataacgtccacagacttgaagcagatagtgaagtagatctgtgagaggttctaggtacttagtgtgtagactttgacgaatatttctcaagttgggagcccttgttaaaaatgatgtttaagggagtggttggggggaagatgaaggcatggaggaggaagaagagaaggaagcccttgccatataaaattcatgcagactaaacagtttccctgacagaataaataaagtggatgctaccccactccagaatcaaaagcaatttaattaaagtctcttaagttgtaaagagttttaaatgatccgtgttgaaggcgaatsctgcyaaatgcagtgggtctgacgtcagctgccgggcctgggctgggaggccatttgctattctgtttaaggcaggctggattgtcttattttggaaccagcttggtggggggtttgctttgctactgcttctgagccctgagcttcaaaggctgaaattaatggtgaacaaaattgtgcggctctggccatcccatgcgggcaagcccattgagggttatcattaagtaaagaaataaagagggggaaaaaagcctgcctgttccaaaaacctcatcagataatgacctcagtgattgggttttcattaccaaacagcatccagagattatcaacccatagaagaagggaggggaaaaaaaaaaaaaaaaaaaattc

SEQ ID NO: 423 - DNA, 1755 bp, Homo sapiens
ggcacgagcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggggtctgtgcctgacactcgggctgtttgtccaagcagatctgaaatgggccgtgagctgggggcagcagcctcccgggagcagggagtcagccctgtgatgcatcccatccaccctgtccacaggtgtttggcttctttgctaccatcgtgtttgcaactgrtttctacctgatctttaacgacgtggccaaattcctcaaacaaggggactctgcagatgagaccacagcccacaagacagaagaagagaattccgactcggactctgactgaaggcctgcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaaaaaaaaaaaaaaaaaaaaa

SEQ ID NO: 424 - DNA, 547 bp, Homo sapiens
  misc_feature (1)..(1): n equals a,t,g, or c
  misc_feature (547)..(547): n equals a,t,g, or c
ncgaaaatgagaaaggtaacaatttcgaaaaagcatgcccttctgctgtgtttccagttgtttagatgtctgctctccatgtatatatggatcacattcgtgttagatggaagttgtgaatccactgttctctcaaaccggtctctttcccttgtacctatcatagtgtacatagctcaacttcctgagtttgattctagtgttcaaagataggtatttttcatataagatgtcctgtcaaagcaagtcattgaacttacctggtatttaactgaaaacaaacaaaaatcagcaatctcttccattgcttgtagaaatactgacttaggccaggcacagtggctcacgtctaatcccagcactttgagaggccaaggcaggagtatcacttgagcccaggagttcgagaccagcctggcaacatagtgagaccttgtctctgtaaaaaggaaggaaggaagggaaggagggaggggtggagggagaggaggggaggggacactctgttatacttatcgaaaggtgctatccaggtgtggtagtgcan

SEQ ID NO: 425 - DNA, 1346 bp, Homo sapiens
  misc_feature (537)..(537): n equals a,t,g, or c
  misc_feature (880)..(880): n equals a,t,g, or c
  misc_feature (1115)..(1115): n equals a,t,g, or c
ggcagaggcttgtgaagggtaaagtttaaacccctctgcttagcccctgcctccagcctctgccaggagtaatgtgctcccatagtactctgatccacttgtatttggtgcttccttttttttttcttttccttccttcctcctttcctttcccttcctyttcctsttcctccattcttccctccctccgtcttcctccattcttccctccctccctattcctccattcttccctccctccctccctctcacatcctttaggactcagcatcacctcctctaggcagtctttcctggaytaccaccayttatgcacaaaacacctaagcaytaccttatgtggcctcatttatcactgcttaaatattttttawacacgtgctgtgatgtggcacatgcaggtgtcattcttgakgatccactggttattgccttgaggggatgacaactgcccggtagggtwacctggtgtgactgcacctaaaacagcaataccaaagggcccattgccagttctgtcactgaccagctggggcntctgagtatatcccttaaccactttggaccttaatttggcatctgtcaaatgagatggtggaacttgaggaactctaaggcccctactgtgcaggtcttattaatgattacaacagcagcagcagccagtgtttactgaggacttacaaagcaccaagcactttgcctatcctaatccttacatcaactctacgaagttagtatggttactatccctattttacagatgaggagactaaggctaagagaggttatatgacttgaccacaaggtcataataaagaaacagatttgaatccaggcattctgactttactgttcttagccacataatgggcacasnttygacacacrgttttgtgtactgtttggtggtcactcacagactccatcccagactctgcatgaaccatccctgttctacatttttaaggctcaaactggagtctgggtgaaacctggggacagaagactgctatagtcacaattattagagggaaatgggtgaggaccagtggccagctctgttcatgaacctttgacaattctcacagagagtcttgctttggacagagacnacttacgttgctgttttcagttaccctctttaggaggggagagtaggcctgagtcatgcttcagacacagattaaaatcagatttggtaccaggtgcagtggttcacgcctgtaatcccagcactttgggaggctgagttaggagtatcacttgaggccagaagtttgagagcagcctgggcgacatagtgagacatcctctctctttaaaaaaaaaaaaaaaaaactcga

SEQ ID NO: 426 - DNA, 1974 bp, Homo sapiens
ggcacgagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataaaaaaaaaaaaaaaaaaaa

SEQ ID NO: 427 - DNA, 890 bp, Homo sapiens
aattcggcacgagattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaag

SEQ ID NO: 428 - DNA, 1043 bp, Homo sapiens
  misc_feature (987)..(987): n equals a,t,g, or c
gaagctggagctccaccgcggtggcggccgctctagaactagtggatcccccgggctgaggaattcggcacgagctttcccctaagttttcttatcttcaggctacagaattattgagattactctcaaccattcctcatgttagaaactctttctcaatttatttccatcctctttgtccttctctggataatctcagatttgatactgtgttttcttaaatgtggtaatcccggaactctagatatggttcttcctatttggactaatcagtatacacattccagtagatccattttgtcctttatctagatacagtatttctagtagcttgaaactcatttgccttttaaaagttgttttaggattaaaaatcacaaaccaaatatccactgtcctcaagagaatcacctaacacccataaggattcttgtagactcatggtaaaggggtagctattgttttatatcagatagcaggagtagctattcttttatatcagataaaacacattaaagcaacatgaataggcatttgttaaaagaagatatacaaatagtcaacacatataaagaaattctcaacatcactaatgatcagggaaatacaaattaaaaccacgatgacatacaccttatcccagccagaatggccattatgaaaaagtaaaaacaaaacaaaaaaaacagatgttggcgtggatatggtaaaaagggaattgcttatacactgctggtgagaatgtaaattagtacaagctgtgtggaaaacagtatggagagttcaagtagatctaccactttatctggcgttctcactactggctatctattaaaaggaaaataagtccctatgtcaaaaaagacacctacatgtctatgtttattgcagcacaattcacaattgcaaagatatggaaccagcctaagtccacatttaactgatgagtggataaaggaaatgtgtgtgtatsmtcaccatggttgncaaaaagagacccgttgcctcctgtaaccagacactcaggctttccaggagcccag

SEQ ID NO: 429 - DNA, 1079 bp, Homo sapiens
ggcacgaggtgttagaaagttttcgaagcagtgtgagtcttgtacctttgtggtcctgtctcacagacacctgtctattccctgacccttttaaatgctaactttctgcctgtaggaaatcttccctttgtgcttaggtctttttcttctgtgagctttagataaacaacctagtgtttaaactttttaataagggattcattttttaatacatgagaattcatttcaaaattttggttttagttatttattttattctacttggctctttttcagacagatgttctctcctggattgtaaaagtcgaattcaaaggatttttatttgtaatatacttaacctttctcttgtaagttgccatctgtgtagatacagctttgattgcctgacaagaggaaaatgtttcccattatcttttcctgcctgaactatacggtcacttgtgttccagcatagtggttcttaaccctcatagtgtgtcagaatcactttgcagagcttttaaaaactctagatgcctggggaccaccccaaagactccattttgttgtcatgggtcaaagcacagtcttctagtttgcagctagtgttgagtacaactagagtttaacccagttgaattttagtttaatcttggctggtcttgaagatgttagtaatctctattcatttttttkgaaaagtaccaatgaratcagaaagttaattagaaaacatctagttgaatcccctgtttttaatagatggggaaaccaagacccagagaatataatccaaagctacctgtcacataggccacaatttcttttccaatattctgttcttcgctgttcttctaatttgcagaactcctctttaaaaaacctttggagaatgtattggcctcataccctcttccttcagcctgaaagacatgcacctgtcacttatttatgatatttaaatgcaacctctagaacaggggtgtccaatcttctggcttccctgggccacattggaagaagaaatgtcctgggccacacataaaatacactaatgatagccgatgaacttaaaaaaaaaaaaaaaaaaactcgta

SEQ ID NO: 430 - DNA, 2103 bp, Homo sapiens
  misc_feature (2101)..(2102): n equals a,t,g, or c
ttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaatgctatccgtgcgagaacagctattccacgagaggatccgcgagtgtattatatcaacacttctgtttgcaacactgtacatcctctgccacatcttcctgacccgcttcaagaagcctgctgagttcaccacagggtgtcctgggccgggtctmtgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctgggtatgtggcttcgtagggcttgggatacctgggtttccccaaggagagtagcccctggttccaggtgcttgctgacagcctcccatccctgcacagagaagaggcggaaggcttcagcctgkcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaaaaaaaaaaaaaaaaaaaaaaaaaaaaaaaaaaaaaaaaaaaaaaaaanna

SEQ ID NO: 431 - DNA, 1370 bp, Homo sapiens
tggttaaagagtacgacattttagtcagggctgagcacagcgcctggccgaggagtgcttttatatgctcttggaagtatatggggactccatttctgtcactgtggcgattccacttatgcattcaccatgccaatccaaggcagctgatggcttaggaaagtcagagactgagatgttaaaatccttggggctatctaccaacatgtctccattccacctgttagggttaaaggtttttctaacctgggccctgaccttagcacagatctgcctatatttttttgaagttcagccacttggactattagccctaaactttttctgtactgccactgcagggctgaaggagctttgcatgcatccaccaagtctggctttcacacctgaatttcacacctcgctttcacccttagctattccatctttctgtggaacatcagtgtcacttagcaatagccatacaatcccattatccttatacctacctttcccttcaaagtctcggatgcctgatacattgcacctgctagtgcattcactcccattagtacactcccaagtccttccagtgaaagatgtaacaattgaatggccactgtgccaaaggtgcctgggctctacctgccaccagtgatggggtcctcacagccaacccagtggtgtatcatccatttccaaaaccatctcamtgcctgttttcttggaccactcctggcatcaactgtttcaggttagagtgactgaaaatttgggktataagatatttattagagatcaatatctattaaaaatgtgaaaggaagcaggattktgctgaggaagaagataacaacaaagataccacaatgtcagcccatcaaagcctttggccaacccagcasaaaaatctggagcaggtgtayctttttcagagtctccccagttaggtcaaaatgtgcgcctttacacccgcacttccctcaatcacgggcttcaggctgtcctgggcatgacctcagatgaagcggctcacacagctgaggctaacgttgtcggagctgacagctgaaagccgtttgctgaccacactcccacagccgagcagcatgcccttgcttggaggaggatttggatgacacagctctatgtctgccgtattttgggggtcacattcctcacacccagctctgcctcaaatggcaacattgacaaaaattcattccagttgcaaaccaattgtagaatactataaaaccagagtacaagtctaatagcataaatctcatcctaagtggaaaagaaagggtcatttattcacacatttttggggaaaaaaaaacaacctttgctatgtctttattacaacacggatactcacaaaaaatagt

SEQ ID NO: 432 - DNA, 1212 bp, Homo sapiens
gccaagcttggcacgargttggtggcggcgtccggaggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgcttyttcgagtacggcagagcttttctcaacctacttttcagacacagatctggtgcccagcgacattgcggcgggcctcgccctgcttcatcagcaacaggacaatatcaggaacaaccaagacctgcccaggtggtctgccatgccccagggagctcccaggaagctgatctggatgcagaattagaaaactgccatcattacatgcagtttgcagcagcggcctatgggtggsccctctacatctacagaaaccccctcacggggctgtgcaggaytggtggtgactgaaattagctggacatggttgcacacacctgtaatcacagctactcgggaggttgaggcgggagaatcgcttgaaccagggagttggaggttgcagtgagtggagatcacaccattgccctgcagcctaagcaacagagcaagattctgtctcaaaaaaaaaaaaaaaaaaaaaactcgag

SEQ ID NO: 433 - DNA, 616 bp, Homo sapiens
  misc_feature (17)..(17): n equals a,t,g, or c
  misc_feature (580)..(580): n equals a,t,g, or c
cmgctrctragcaactnagtgggatsccccgggctgcaggaattcggcacgaggagaacggctgcacgtgggagatgctccgtggatgtttgtagaacgctggcttccgtgtttcctcgttgtggctgtggtggtgtgggtctttgcctgtggacccgtggaagacaaagaagacagttttggatggtcaagctattttcttgcttcagggctccctcccctgctttttgaagcctcacaaaccaggactgtgagggcaggaaggcttggggtctttgtgtgctgagcctcattagggttttaagaacctccctcctttcatctctagcttacgagagggatgattcattatcttccctcctcaggctgcagtagaagcagacagtctctgcctccctgcttgcctttcctccctcccattcactgttgattattgccctcaagaataacaggttgcccagctactcgagargcttaagtgggaggattgcttgaccccaggagttcgaggctgcagtgagctatgatcgcttcactgcgctatagcctggcagacacagagagaccctatctcaagcanacagacaaacaaaaaaaaaaaaaaaaaaaactcgag

SEQ ID NO: 434 - DNA, 575 bp, Homo sapiens
atcctctggaatctaggtggaagccaccaagccttcttcacacttgcgttctgagcatctgcagacttaaccccatgtggcaatcaccaaggcttatggcttgtgtcctccagaactgtggccagagctgtacctgggcccctttgagctgaggctgaagccagagtctgaagctcagcagggcagtarggccctgggcctggcccctgaaaccattcttttctcctaagcctctgggcctttgatgggargggctgtcctcaagatttttgaaatgcctttggagggtttttgccttgtcttggatattggcttccttttagttatgctcatctctctagcaagtgaatgtttcacaacctgcttggattctttctctaccacagarccaggctgcaaattttacaaacttttacactctgtttcccttttaaatataaatttcaatgttaagtcacttctttgctcccatatctgatttaggttgctggaagtagccaagtcacctcttgaatgctttgctgcttagaaatttcctctactaggtagcctgggtcatcacacttaagttcaaa

SEQ ID NO: 435 - DNA, 1144 bp, Homo sapiens
gcacacatacgtatgcatataaggattatcatatataaatttatataacaatttttatgcatgagtgtgaataaatatatgcatatatatgtctgtatatgtaaacataatgcatatagtaatttacatatatctgtgtgtatatatgtgtgtggcacagtcacacacacacacacaaatatgtatacagatgcttcctggcttacaataggatttcatcctgataaattcatcgtaaatcaaaagtattgcaagttgaaaatgcatttcataccccagtaagttcatcatttgktcaaaagtattgtaagtcagaatacatttgacatctggataagtccattataaagtcaaaacattttaagtctaatcattgtaatttgggtaccgtctatgtagatacgtaaatcatacattaagggtgactaggtgccaggttgaatgttatgaaaatgaatttcaagtctcacaggcacattcacccattacaaatatgtaccacattcacctattacaaatatgtacacatgtatgtgttcatgttcatactacaatggcagagttgcataattgtgacagaaatcaaatggcttacaataactaaggcatttctacatagccttttaaagtaaaaagtttattcattgttggtctacataacgtggaggaatttgtagcggacaggctattacagtcagtgaattgaaaggaagggagaagttgggggagactagtagctttttgaaggtattattttagagatttatgaakttttggagaacaagggatgaggaaaaagtattgaagaatttgggagagcaggatatcaattagtttctgactttattgggaatgcagatcagagaaaggctgggatagaaaactgaaataataattatagccttcggtgaatatcagcaggactgatgggactatagggagggtagactaggtgatagagcccattgtggcagtttcggtaggacatcattggtgtatacgtatatgttatttgtgattttgtttatctttttttaataagcaaaaggaaaagtgtcctgatatgttttggctttgtgaccccatccgaatctcaccttgaattgtaacaaagttttaccatgttaaacaggctagtctcgta

SEQ ID NO: 436 - DNA, 703 bp, Homo sapiens
gcttggttacgtttatagcttcaacacgcctctcattktaggtttatacatgtgtttgcttgctcatttattttgtcatcatttgctcattttattaccagttattgagwgcctactgtgtaccaggcactgggcaaggggcattctgtgagagagggtatggtacctgcgggcttaagtagtccgtgggcttgtgaggaaaacgctagattagatcttgattactgtaaatgtcaartatggccaagtgtgggatttcgtggcaggagtgagctttcctggaatttgtctttcttgcctcaatttgcctgatagtcatttcatgctagggatgttttaaagtctctggggaggccctgcagtgtagaggaaaatgctgatccacaccagaaatgcgaacctggctctctgcccttgggcaagtcacttaaccctcctgagcctcagtttccatctgtcacttagagctgattatacctacttaacacccaggctttttgtgaggggcattatctcattagagataatgtttttaaaagctctttgtaaattgtgtagcattcaaatggaagttattgttatttttattattgagtgccttctaattcaacactgggatagtaacaaaagaagagaggggttattatcacccctcttccctgtcacgtttagattggggcaaggaaaggttctcaccctgcga

SEQ ID NO: 437 - DNA, 1649 bp, Homo sapiens
  misc_feature (1249)..(1249): n equals a,t,g, or c
agctccaccgcggtggcggccgctctagaactagtggatcccccgggctgcaggaattcggcacgagggatctgtgtggcatggtatgtgtgtttatgtgtattgtgggtgtctgtgtggcatgctgtgcgtgtgtgtattgtggatgtttactgtcccgggcagtagaaaggacgtcggggaagcagccccagcatcagggacaggccaggagtgcagaatgcatggaagctggtcaggtcggagcctgggatgaaggaagcacagagatgcaagggtgccagggcccatggaaccaagagccgatgatcaaggccacagtgcacacagccctggaggcaaaggacatattcatttcacaaggattaaaaagcatgggccaaggctgggccccaggccaggactggggatacagagtggatcagtccccatccctgcccccaggtgcttacccacacccattcacctcacaggtttccccaccccagccccttggcgagctcctcctcattcctcaaarcgtcgctkaggtcacgctccttcccgaggcctctccccatcctctaaaacaccctctccctgctgcccacttgcagcacagtcagagagctccgtggcctgtttccactggactgagtcttctggggggtgctggtgcagagcagarccctgggctgggagtcccggcacctcgttccactccctcacccacagcctcgctgtttaacctcaggcaggccgtgtmcctcctcagcctcactttccccttgtgtaaaatgagggaagggactgcgccttctaagccatctttcagcttaaaacctctttgaccttctatctggctaatggaggtgctgaccaggggcaagaagggatttgaaaaacgctttgaaaaattcatagcaggaggcaaaggagaaagagtctttattttcgtagagcgggaggcaggaggagttatggacagaggctgtcgatgaaaaggacagcatctcagagcactttgtggcatttaatgtctaatgcctcctcccattaaagcagtggcatcaaatatttaccaaagcagcattaaaaattaacctttaccatggggatgtataaaggccctaagttccctgagaagtgaccgaacatcaggagggtaaagtgacaggaaggaaggctacaagcgggttgtgaataatggaagcccccaaaggtcccccaacacagctccctgttgaccccactcccaaagccagggcancctccggccgtgtctctgcagaggctcccagcccttcggagactcccagagggcctgcaggataaggacaggccctcagctgggcatccacagccttccatggcctggccctgcctctctgggcagctgggatctgtaggatggaaaggaatgagtctgtcggagttggaagagaccaggggaggaagtggggagtggtccgggcactggaaatagcacgtgcagaggcactgaggcagagacagctgcacatcaatccatcagaagagcagccaggtggcatgagtgtgggggaggaaggaagcgcaggaggggacaggtgggagatgcaggtaggtctgactgtgcagggccatggtaagatgtgggcttctcggtccagggacaggggtgccctcga

SEQ ID NO: 438 - DNA, 639 bp, Homo sapiens
  misc_feature (62)..(62): n equals a,t,g, or c
  misc_feature (126)..(126): n equals a,t,g, or c
tcctttcatcttaagcaccacccgacagggcaggtactattaccatctccgtttgacagatnaggaacctggcacaggaagcatttaagtggattccccaggatcgccccactgtcaggagcagantcagaatgggcctcagcatcaggctcccaatcctggcttctaactgctgcgctctgcccttcyctcwccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctccttataaaaatgtccctcagtgtctgctatgagccaggtgcagacttaagtgacagggctgctacgggaaataaaaaattaacaaggagcacctgcctcttaatgcacagtaacaaactatgttaagtgtcaggaaggaaaggttaaggatgccaggaaggcttttaataaataacctgacttagatgggcaggtggtgctgargattaagaacgtgttcttctcga

SEQ ID NO: 439 - DNA, 520 bp, Homo sapiens
gagaaggactttatgcagggaagtgacgcaggacacggagggactcatatttaccgagctttggtgcagtggcccctggcctgggtattctatttaagccatgcaaaaacccattggggagaagagttaaggttttccttccgcaggaaaaacttgaggctcagagaggctatgagacatgagacatgccaggtcacacagctggtagctggcaaagctgactccaacctgtgtctgagggactctgaaacctggttctggcccccactctgggcagcctgctcctctctacaagccactgcctgcagattaagcagtcctagcaaaggcctgggagcatccagagagtgcccctggctggcgagtggtagagcagccttggtttccttcctttgaccctcaaggatcacaggagtgtcacccagaagtaacttaacttatgagtgttttatgaacaggaaaagcaggaaaaggggtaaagtcacatgatttcacaaccaaacagcctgtaaactcgtgc

SEQ ID NO: 440 - DNA, 524 bp, Homo sapiens
gcacagagggcttgggtgcaggtggtttatttgggaagtcatcctggaaaatccaaaaggaagggatggagaagagatagaagacaagaaagaatgcattgctcgtgggtcatgggtatagaaagtttctaggaagcttctgcagaaccctatgcaatgtgcctcgaattgtccaaggaattgaatggggagctggtgcatttgtacactacttctgttgctcactgatgggcaacagggcttttatccccagcctttccaggctgccccggggagacagcagctatggggaggcaccaacccatgggctgtactcattccagaatccttcctcccctacacgctgacagtcaattattcaccaagttgtaacttcgaattctacttacctaaaatgcgtttggcatacatctgcatgtcacactcacactgtccctatcttggtcgagacattataatcactctcctgaactactgcagcagcttcctagctgaactcctggctcatctggtctatattgctg

SEQ ID NO: 441 - DNA, 1035 bp, Homo sapiens
  misc_feature (55)..(55): n equals a,t,g, or c
  misc_feature (110)..(110): n equals a,t,g, or c
gagcggataacaaatttcacacaggaaacagctatgaccatgattacgcccaagntcgaaattaaccttcactaaagggaacaaaagctggagctccaccgcggtggcgnccgctctagaactagtggatcccccgggctgcaggaattcggcacgaggttacctcctctctttcagaaaaaagtgtttaaatttaataaaaaaatacagacttcctctctctctgacctgtttctgcacttctaattttgtcccattgttatatctcaattctgaaacaagtcccaaacctttttgtacactcaggcttttattatttataggtgtctttaatgtggtttcgctgttttttgcttatttttgtgagcagtgtgactttgacaggtgactttagaaacatgaagaagccaagcagcctgtgcctctttagacagggcttgatgtctgcttctgaagttagtggcagcggaagtggagaaggggattgaaaggtatctttaaattcgraattatagaaagtaaaaactggtagatgtgaggacagtggggaaactaagatcatagtcgcctaaggttctgttaatacttgagttgaccaggggggctggttatgacattgatcatgctaaaggaaaagatgccaggaatgagctggggcagagtgaattgggcagccttccatcttgacagcacaccaaaatgtataaattagcaaaagcccatctttccctaatgccactaagctgtcagtttctggaattatcatcattattarattcataatggttttaatraaggtgtcatccaaactgacactttgaaaataaagtgagatgatgcctaaattggaggcttggaatgaccttagaaaactgctccaggaaacttgagaatgtcccaattacttaaagaactctgagtcagctacatggctcattccattcatttgctttgcattggagagatttatttggattgacacaggttcatgcctcccagaaggctccacctaaaccatcactctgctttctcgag

SEQ ID NO: 442 - DNA, 660 bp, Homo sapiens
gaattcggcacgagcagaggcccggtacctttaagctctacctcgccaatgccctctcgcctagtaatccgtgcacacagcctgctgtttgccatgcagaatgatggcctcaagttcatggaaatggtgctccatgtccttcaggcaagtataggtgttctgttgcttatggtggatgtgctcgagcattttcttgccatgctcattggcaatgcaggggctcctttgccactgctggatgtgctggggaaggatgttattgatgtggctgaaagaagagagagcaagaaatgaaatgggtagatggggacatcagaggaatgagaaagatgagctaccaaatggtgactctatagggtactgagtggtggatgagtgcacgttggtgaatgggtggttgaacagtggacgggtgggtggatgggtggaggggcaggtgggtgagtggctataagggtggatgagcaggtgggtgagtggctatgagggtgaatgagcaggtggatgagtggctataagggtggatgagcatcctggtggatgtaatgtggatgggcagttcagtgagtgggtgactatgacggtggatgggtgggtggctgagtggaattacagatggcatagatcacaccttactttgcctttgtcccttaacctcga

SEQ ID NO: 443 - DNA, 1042 bp, Homo sapiens
  misc_feature (222)..(222): n equals a,t,g, or c
gaatcggcacgaggaaatattactgaattttcttttattatcaaatacaaatttagcatatcctatgtaaaatgctgattgcccttttctgcatattatttcagatcttgttttctatacccacaaggattttctatatatttctcataaacaagagagtccacatatttactacttaccttatgagtgaacaaaaaaatcacgattgggttcgcagaactncaaagttgcaccgtgtgtggctcattagtggaaaaatgctgctggttgcagatataaaggctctgatcaggtggctgtggggccctaatccagaatgagcacagttattttgatcaatggagtctaacctagtcctcccccaaggttcaaaatgtcctctggtgcttgcaattttcttacagtatttttttctaattgataccaagctgggactctcctggtatatcatatttggaaatgaaaagtgaaacaaatgagaattttccttttgcgttggtgaatgcatacagtgatttaagtttgggtgcatttctttcagtctgttgattgttctaggaatcgatgctcacagatcaatgagtcatgtccaatttcataaacaactgcctggggtgagtgtggcctcataaatgtgaacaaatagtaatggagtggcaatcaaacctaaagtgttactgcaaatcatgccatgctgaaagaagaaacatctcaaaaagagaataaacatttttagggtcgggtgtggtggttcatgcctataatatcagcactttgggaggccaaggcagaaggattgcttgaggctaggagttggagaccagcctgagtaacatagtgagaccccagtccttacaaaaaaaaaaaaaaattaacaaaggattgtggtgcatgcctgtagtcttagctactcgggaggctgaggagggaagacaactttaacccgggagttcaaggttrcagtgctatgattgcaccatcgcgttccagccttggtgacagagcaagactctgtctcaaaaaaaaaaaaaaaaaactcgaa

SEQ ID NO: 444 - DNA, 536 bp, Homo sapiens
  misc_feature (536)..(536): n equals a,t,g, or c
ggacgagtggggagctggaaggaggatggagtgggaagataatcttcccttggagttcagctgtcccgtgaccaaactcctctctgtccccagctggactcctctagatgctcagatgctccttctcttctttccttctctgtcacaccattcttctgttccttggctcttctgctcatctccttgtggagscawaggtttggggtttatatgagtacaggataggtgacatggtggatcaaaaggcaacattttgtgtgcaaaaacaggaatgcctgttcccattagggtcatgggttkccagggttgagggtggggcctttgctagggaaccaccctcttctacccagtattttcctgtctcctgtctgtatcaataggtacacaatatwtattaaattaatkaatgactatacattatgaaatgggaaatgcaaggtataaaggagaattgctgtccttgaaaagaaatttagtttgtttttttgttgagatggagtcttgctctaagctagagtgcagaatgtaatcaaggn

SEQ ID NO: 445 - DNA, 1095 bp, Homo sapiens
  misc_feature (616)..(616): n equals a,t,g, or c
gatggtatgtgtgtggtgtgtatagggtgaatgtgtggtgtgtgaggtgggcatggtgtgtgtgaggtgtgtgtggtatgtgtggcatgtgtttggtgtgtatgggaatatactatggattaggacatgtgggttattcaaagatctatccttttgtgctttgaaatctgaaatgtagaaactgtggcctcactgaggaggagttttagaatatgcaagggagatgatcaggactggatcttgtatttgggtaccacatccagtcccagacagcatgctaaggcaaggagctcataaaagccccaagctctagctgttggctacttatctcctggagcatcaggtgagcgcgttcaggctggggagtcctgatggctgcctggttgttacaggatgttacagcttaggcctggggacatagcccagcaccctccagargttgtgtctgttctttactcttcaggttccctggaggcaggagaggarctggcctcatttctggcaggcaccccactactgttattgagcaatcctccaggctgcagagatgtcagaggaggaccctaatgtctcckgattttgattattttgttctttttccctaggtgttttactngcagataccttgagtaccttgtttgtatattcactttgaaagcacacatttaaatgtttataaggaaaaggttctaaagacatccattgatccattcattcatcattcagcaaatacctgttgaatacctgctgtgtgctaggcactgcggtgggcgagccagarggctttgttgctccaaggarcttgcattctagtattctagttattttcacgcatctgcactatctgggacagggaccattgcgttttgtcgtatataaagcagcatgtgtctgcactacagtttgtgtccgtygcagatgggcaaggattgagtgcaaaaacttctgggccaaaaggggttggcttgggtcaggctgctaagtagctgaggtgaaagcatgtgccacccctcctgatacagggatccttgctgattgtgtgtgacaccagggccttcccatctgtcagctgggtttgtcctcacagtagctcga

SEQ ID NO: 446 - DNA, 427 bp, Homo sapiens
ggcacgagaaaggagccacatttcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctcyagggcyatgatacakgtttcctatttccagatttttctttatgttctctctttattt

SEQ ID NO: 447 - DNA, 796 bp, Homo sapiens
ggcacgaggtgacgtgtttctgcatctgttgccatgacaagctccctgcttcacccattgctgtatccccagcacctctctcactgcctggcaagggaaagcactcagaagacgctgaatgaccargtagagtgatgggttgtacagcactgttactccttttccatctctgtgtcccatgtgaaccttatggcacccatgagaaggagcttgtaccaggtttatactttctagtttacagatgagaaaacaggatcagagtggtacagatattggtctaagtcacagagaaagtgaattgtaaaagcagaaacagagcacaggctgcctgacttctagtccagtgctttttgctcaaattgcctcttatttctcaggttattcttgaaatggcagatggggattctgtttaatgaaacaaaagtgacaattctttctttcttggagagaaggtggagacagggtctcactctatcacacaggctggagtgcagtggctcaatcatggctcactgcagcctcaatctcctgggctcaagtgattcttccaccttagcctccttgactcactgggactacaggtgcacaccaccatacctggctaatttttaaagttttttgtagagacagggtctcactatattgtgcattctggtcttgaactcctggtcccaagtgatcttcctgcctcggctttccaaagtgctggaattacaggcatcacccccatgcctagcctgaaaattctttctatgtccttaacatcttctttcccagtatttctccatccactcga

SEQ ID NO: 448 - DNA, 1037 bp, Homo sapiens
ggcacgagctcgtgccraattcggcacgagggtcatagtccacagaggtaaaagttaacaattctgatgctcttgtatgtgcataccagaggctctagggaagaattccctctttctttcttccaccttcttgtggctgctggcattctttggcttgtggtcacatcactcctatcttgaaggccagcatcttcaaatctgtttcttcttcacatagccttctgtgtgtgcagtgccctctacctctctcttataaagacatttgtgattaaatggagggtttaggataatctcgtcaagatccttaacttaatcacaactgcaaaaacctctttcccaaataaggtaacattcacaggttccagggattaggacctattatctttggtaagtattattcagcctaccacaatagctaaaacaattctgaaaaagaagaataaagtgagagaaatcagtttatctgatttcgatacttattgtatagctatggtaaataaggctgcatggtattaaagaaaggacatatatgaatgaaacagaatagaggacccagaaatagacccacacaaaggagcccaaattatttttaaccaaggtagaagacaatttattggaggaaagacagccttttcaacaaatggtactataacaattagatatccataggcaaaaaaaaaaaaaagaatcttgatctaaggctcacaccttatataaaataatattaaactcatggccaggcacagtgactcatgcctataatcccaatacactgggaggctgaggcaagagtatcacttgaggccaggggttcaagactagcctgggcaacacagtgaaactctatctctacaaaaaaattataaactagctgggcatggtggcacatgcctgtagtcacaactactcacgaggctgagaagatcacttaagctgagttgttcaaggttctaatgagctacaatcgtgccactgcactccagcctaggtgacagacaaagaccccatctcaaaaaaaaaaaaaaaaaaaactcgta

SEQ ID NO: 449 - DNA, 828 bp, Homo sapiens
acgagaacaccatgctagtgagttcattcctaacagaggagaacttgcatcttgactaagcattagtgatctcaaatcctctgcttatgatttttaaacttctgatcttcagaatatttttccatgagctagctctggctttgtgcatctcaaaccttgtttctctcccatggctgtcatacttctggtgccctgagatgcagaatttatttctacttgatacacacatttgggtattgatgtagggttagtacagcaggtaggttgagaatttctggagcctccctccctccctttgttctgacctttccttagtcatatcatcctagaaagatcttccctggcttcgtctaaaacatggcctctcatttcattctctccctgacaaccctgatgtagttttcatttcaggactcatcaccccaacatcctttcctgtttacagcccatctcccctgctagaacacaagctctgagaggtggaaggcctctattgtgggttttggcgaatccccaatctctagatggtgtctggcatgtgatagagattcaacaaacacttcaacaaataatgaataaagttaaatttttcagagtgcaatcatgcctctcccttcctctgccagggcggaggctgtgcctggtttgcgcggcttctgcagctccagctccttgtactgagtctggagaatgatggagctcagtccattttaatcccatgaacattaaatgcgtggatgtgtggatgctgggatggatggatgacgctcctagcacggcagcttgcaggggattggcgatttccagtaaggtgtgctaagactcgag

SEQ ID NO: 450 - DNA, 1110 bp, Homo sapiens
gaattcggcacgagcttggttcgggggggagcaaaatccagaatctgctaaacaccaatgctgtcactcagagtttgtgtatctgctgtctgtggagctctggaccaggcttgagggacgcctggggtttccacccacatctggggcaaaccagacccccaagtcactgacatgtcggtttttctactaatcacgttggctttggcaattctgtatataataagaagtattgtgttctcacttgcacttkggcagaacggttcactccaaggctgaatgactgccacggaccatcccccagcaggggtcctggggtttagtggtttgattctgagcacctctamgcamagagccccttagtgggttccctaactggacggctaaccctgstgtggaatctgactkkwtctggaccgaagaggacaggctgctctggagaaatccttgggccttgtgcctgatgctggctcgggccaccctggccaccctcccttcatgccccatgggaccaggcagcagcatgggagggggcagcttccagaacacccttctgctaggggctkctggcctccctgctggcacggccacatccatggtctgagtgtgtggttggaatgttttatcaacaccagtcctcacagcttccccagatgagcgaaggggaaggggatggtgtgtggggggattgcctcccttgaggccccccagctcccaggatacttgctggcggagctctgcctgcggtggaggccctatgacttgacctccatcttctccctgggcccctcgctggccctcactggcaggggctcctgcacgcctgcaaggccagagcctcccgccaggtgcaggagaagtaaatgcaggccagagataaatcgtatttccctctaactcggatgtggagtgagaggaaggaagcaggagtggagctgagtgttagtgagaggtggctgagaaggcggggtcccgcttcttgcttccttgggcatttgctgtaggtgctgggtttcagcctggaagggtgcagcctctgcactaagtctggtttggtgaacgttcatggcccccaatataaacagtgttctgggcgttctttgtgactctcga

SEQ ID NO: 451 - DNA, 841 bp, Homo sapiens
gggctgcaggaattcggcacgagctcgtgccgactctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgaggggg

SEQ ID NO: 452 - DNA, 2128 bp, Homo sapiens
gtctacctccgggctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccatggggcaccccatggtggtgcgtccttgggagcagctctgtccctttccccgtggcctttgccccgcctcctatgacttcgattcccacctgtccccgacccctgggaccactgaccgggcccgatcaccctgtcactgccctgtcatctgcttaccccacacggtgctctgctgacccaggtcttgctgtctcccaacagccccacgaggcttcccgtcgctcctggacactgcaggctgagcccgctgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgagtcagggtttatatgcaggtgtctacaggagacatgctgggttctgtgctgggtgtgaggaatatgggagcagaaccccagggaggtggcagagacttgggggccaaagggctggggtgcaggggggcaacagccaggtgccactggccaccccagccgcagggagccctgcccaccctccaggtgcctggatgtccaacctcactgctattcccacctcaagccaggcctggagatggaggccccatgactcagccagggccggtttgcagctgcggctgacccagacgggcgggcagcccccagcccccgggcctgcacccaggacagggccgccctccctccctcccccgcttctggctcctaggacaggattctctgaattcagctcccctgaggctggggccaggttggaggccaggcctgggggctctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaggcccatctggggcttgggggtgtctccccaactctcagacataaggacacccttccaagcttgttccttcacctggcggggccctgagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgagg

SEQ ID NO: 453 - DNA, 956 bp, Homo sapiens
gggctgcaggaattcggcacgagcagagacccccaccccccagctgtcctgatgccccaagccaaaacataattcctggcagctcccccactccccctccccctcactcttctgccacccagagcttggcccgcctccaacagcccatgttctaattctgcagtttccagaagcccaccctcaaacccaggtcacttccccagcccctccagcttctagtccccgggtcgtgcccatcctcaccttcctgggctgaaacaccacattaggcacccagatgcctctgcatctgaaaatctcacaagcctggatgtccctgacgccacccactccggttctctttctctttctcagcctcctgtgggctcggttttttctgtccaggcttaaatgcccaggtggctgtctctgctggcccttacttctctcacggggatcctcagcggcaccctgggcttcagtccccatggatggagcagcccacgccgccatctcagccccaggcctgagtgtccagctgcttcccagacaacttgcaagtccctcggccaacactgagctcagagtcctcctcctccctgccagggtgcgccactaccttccctccagttttcaccaggtcttgggttcatcctgactccctccttcttctctccccgtccctgccacacctcactgctcacaagaaagacatcactgtgtccgttctccttttttcttttcttttcttttttttttttttttttgagacagggtttcgctctgtcttccaggctggagtacagtggtgcgatcttggctcactgcctcccaggttcaaaaaattctcatgcctcagccttccaagtagctgggactacaggcacgcgctaccacacccagttacatttttttgtgtatttttagtagagatggcttttgccatgttggccatggctggtctcaaactcctggcc

SEQ ID NO: 454 - DNA, 742 bp, Homo sapiens
gaaacctcaggcaagttcctggccatccccaggcctcattttcccatcaggaagaaggaaataagcacacctgtctccccagtctccctgcctggctcactgggcaggcaaatgtgtgggaggtgattgcaaaggtaccagatttgccaaatatacgcttgcaattaaatccaaaggcctgtcccacagttgcttgactttttttaaaggccaatttatcctcctttcttaaagactaaacaatttttccacttcatttattaaaataaagctctttaacttgcacgcttttagacaaaagcaacagtactctgaaatgaccccatcacttctcagtgagaagctgtgctccctgttctttgtgcttcttgggattgcaagtgcggcctttgtgagtgctctgtgggcctggagcagccacacggaaaggctcacagctgaacccagcagtagcatcacctgcctttccccaccctggttttttttccctttctaatttggggtcctcttatagctcctcaaatacaatgtactcgtgtccctcagagccactgcacagactgtcccctctccctaaagagaccccgctcttatcctccccctcccctacccmacccagtcagccagctgaactctggttcatcttctgcatccgggtgaaaggtcaccttccttgccagtcaacccccaccctcccactgcagtcatcagagatgagcagcctctaaaacctgccctcgag

SEQ ID NO: 455 - DNA, 1298 bp, Homo sapiens
ggcacgagctgagcccagcccggcctgccatcctggcaagccagggcagcatggaggtagcacagagtggcacccagccagcgtgaatgcataagaatctgcacgtgacacagaagaaagtctcttcatgaagtaggtttcactggtcccagccaaaccctgtggcatgtggccctttctgcacctgctgaacatgccattcaccttgacccaggtagtggcctcaccctcctcttgctcaaactggaaacctcagcatcctgaaatgcctcctccccaaatccattgcacacatgtgtgcctgtgtatgcgtgtgtgtgcacgtgtatgaacccagcccccagctgcccactccattgcccctaaacaggcccctccttggtgtcacctggcacatctccactggaagccaaatggatatttctaaactgaaatctggtcccacctcagaaccccttccacagttcccttaaagttcctttcctcatttacatcaggatcttcacaatggggacccctggtcacctcccaacccaacaaacgctccaaatgagccgccactgcagaaactcattatggcccgggcaggactggcacatccaagtatctgaccaggctgttccatctgccaggcaggtcctgccctctctccacccacctgtctaacccctgcatcctcaagaccctacttagctatggccctgtgtgaaaggtccctccccatgtacccacagccatttgttctctctcatgtggccctaacaggctggggttcctggagactccatggggagccaggcatgaagatggcatatacccatgtgtcactccccagaacgtgagctgcctgccctggcaccatacacaaagggactgacagccccagaatcccaaggggtgcacctatgcatatgggaaaggcatgtttacgggtgagaatggtccatcgttgggcttcaggaggcatctgacctgacgcacgcctttgtcactttgtccttgtggcctgttgaaatgccactcctgctttacaaattcaccaactgttgcatgagtcatttccacctcaatgagtaccaggtccttgaggatggggaaaagtaagccaccactgtgggggtcctgggctcctaggtgcagaagaggctccagaaacaggccaggtcgtgggccatgaccccacactagccctctggtccctcacacgggtggattggggggctgtgtcacgggatcttaggatcttcaagacaaagacccaggacaagaacacaagcccactcccattcttcacaggc

SEQ ID NO: 456 - DNA, 905 bp, Homo sapiens
gaattcggcacgaggtgatgaataaataaatcaacagagattttaccatgtttttttttaaactgatctagtttatcactctcttatctctacaatttatctttcactcaaagaactaaagttatcttccaaaaacacagaatgaatcagctcactctcctcaagactcttaaatggtccttcattacttgttgagaaaagcccagacttgtttagtggagcaattaaactccccacaatttatctgccagaagactttctggaaccatgtatggtttttttgccctccaacttacagtcttattggtccattatttttttctcatcatgccacacatttttgtgtcaggtaattttagtcttttggccttgttcttactatcagccaacttcatagttgaagtccagagttggttgttgttgttgttgttttttatckatttaggtaggagttacaatttttatttgctttgtgacagcattattttctgacacattttcttcatattcttttaaagagtttcttttttaaacccatgttattcaaggttaaacaaataacgagtttctttgtttggatgttatgcttacacttacttgaatatgttgttttttttccagactagccattagcaagattcctgtggagtgagggagtgcccagggtagttctccagattattctgctcaaattcttcctcttctcatgctgcagtgatgaattatttcttcaaaactatgaccccactgtgtagctccacctttccttgttctcacaagagtgtacaaaatcgttgagtcttctgagccatggctaacaagaatcctagctactgccttccactatatctttccctttttaaaaggagcattttctgagtttagtcatctcaggccttcctcga

SEQ ID NO: 457 - DNA, 762 bp, Homo sapiens
gtttttctccttcttagtatcttttgcatatagaaaataattactatgaaattatagatttgacgtgcaaaggctatttcttgaattttattaaaatgcaaaaagatgcatccatgtcttctctaaaaggactgcgtattcctccacacttggggaaatgcagcttgtgctatttcacaggctcatcatgccccttttttttgccaggacgctggttgattaatgccatgcttggggagtgctccagccagaaatgagggctatcgcctgtggccaataacagagcagattctcaataaacatccccttggtgttacacttaatggggcttgcttttccaaactgctccctttcctgggctctgagcagctgagccgagagctcgtaagctctgctgccccagaacattgtgcattcyttgattttgaaaartctttcctgaagsctcctcttgggtcattggatcagcccaagagcaaaggatttaaaagggccaatttgatagggacagctcatagccctgtgtaagaccactgggcatttttcctgtttggggaaatggttactggattagcattttgctgtacagggcggtctgcaagaatgtgtgctcttgcctgtcctcaaagcaggcttgtgaggagctttctgttcccagccctgccatttcctcccaattggctgggccagatgctccagacacagttaatgagatgctgagtgaaacagagccgctggctcacatggcctcagcctcctcga

SEQ ID NO: 458 - DNA, 725 bp, Homo sapiens
aggttctaagcattttgcttgacctgactcatttaatcctcacaaaactctacaagataagtatattctcactactttacaggctaaaaatctgaggcacagaaaagttactgaagctccaaggtcacactgtgtaccataagtggaagagctaggatgcaaacccaggcagccgggttccagagcagtgttctaactactaccctctgttgcctctcattcatcccatgaccttcttttgtcttacctacactgggatgtgtttgggacatgcattttgcttgttgctatctcattcttgcagaatgcattgtacttgctatttgtgtctattcacagttcaggttttgccaggcaagtacaatgaaggaggagaggggcaaaggaattgagggtgcctacaagggagtagttagagagatggatgtgaaatctaagctgggcaaattgagaagtaaggacatgatataggtgatgggcagtaaaaatatgtaatgtcagcagtttaaaggactggatggggcagatattaattggagttgcaggactaaaggagttcaaaatataggaaatgaataccagagacagagagagggctgaagtcaaaatgttggaggtggtacttattattaacaacaaggtctagaggatgaccgcagaattggggtccaaggtgacacatggctgacagctgtcattgaccacactgtaatgcagaactcgta

SEQ ID NO: 459 - DNA, 606 bp, Homo sapiens
tggtcccccgggctgcagattcggccgagaattacacgaattaawttattcatgaggctacatttcatttcatatgcatgtttccaggttgtattctcttgtgcaatctgtgtatgttctttgtcttatctttttctatgggaatatttgctttttattcacttataagagcaatgcatgtatcaaggttagattttaattttgcaacatattttgtggcataatcaggtttaaaatgcttgaagttaccatatatgtaaattttttcttcatgttctttgcatttaagtgactggaagagttcattccttccactgaaatcactgaataactaccttggctacttggtgccaatgatgaaggcatcatatttatacccctcaaaggattcacagtccaggaagaagcagacaaacgaagactttcataagtgctatggagagccaaggaaccatctcgatctgctgggaattcctggggcaggaaactgaggatgggactgtggtccaaggaggcagactctgaccaggctgggacagggaaggggagcgttcaggtcaaggtggtcggccttctgtcagagcatactgcattacagtactcgta

SEQ ID NO: 460 - DNA, 793 bp, Homo sapiens
tacgagactagttctctctcgtgccgctggaaagtaagcaggccaaatctagtagggccttgggtcatcgtaagtagtttagatatgaagtgcgtagaaatccttggggaatctgaagcagaagagtggcgtgttctgatttaaggtttaaaaagaacacttggctttttgagttgagaaagtattgaagtgggaagcccagttaggagtttttgcagcaagaggtaaggatggtggtagttagatggagaggccagggaagcttcagagtctgtgtgtgtgtgagtgtgcgtatgtgtgtgcgtgtgtataaggaacagctaaacaacttgctgttggagtgggtgctactgagagctaagtactgctagctgctgcagaggccgtgtagagcagaacagagctgatctttgccttcacaggtgtttgacagttctgttcgtttctgaggtgtgtaccaaaataaagtaggctaagagcatttgactttaagatttgtggagctcgggggtgttgarggggatgcagcwaaaaacagagtctgttaataacccttgttttatattgcttaataacctgtagtctctgttagtgggtcaaaggagaggcagcagcagatgatctttaaggtacctgtctttgagttagaaawacatagcttgaggaagttatgtagcttccctacagattacagctaatagtagaaccagacttttaggtgagctcatgcacacatcaagtcttagcacactgcctagtatatgtctagagctcaataaatggtactcgtgcc

SEQ ID NO: 461 - DNA, 426 bp, Homo sapiens
ggcacagggcaggagagacttggtccatggggagaagcctgcagtatagatgggacctccaggagcccaagtagcatagaccctgctgatccggggccattgagccagaggatttgggctgaatgtccccagagacaaaagggaaaggtagatcctttcccttaaagatgaaagccatcgcccgggcttgcttattgctctctctcctggtccttccacatgttgtttctgaacatttgttctggcatcacaatccccgtcatcctgtcatctggcccttcccacctttccaccttatctcttgcagtgtctccgcgtcgacctggcacctgggtgaargcttgctcttgctggtgcccatagcccccagtgtatggtcttgamctccccagccatatggaracccacctcaggagggcccctcga

SEQ ID NO: 462 - DNA, 843 bp, Homo sapiens
  misc_feature (1)..(1): n equals a,t,g, or c
  misc_feature (486)..(486): n equals a,t,g, or c
  misc_feature (489)..(489): n equals a,t,g, or c
  misc_feature (492)..(493): n equals a,t,g, or c
  misc_feature (529)..(529): n equals a,t,g, or c
  misc_feature (572)..(572): n equals a,t,g, or c
  misc_feature (681)..(681): n equals a,t,g, or c
  misc_feature (731)..(731): n equals a,t,g, or c
  misc_feature (771)..(771): n equals a,t,g, or c
  misc_feature (788)..(788): n equals a,t,g, or c
  misc_feature (797)..(797): n equals a,t,g, or c
  misc_feature (809)..(809): n equals a,t,g, or c
ncgaatatgtgtagctcagctgttttgaaaatgatctgtttgtagaaggccacaaagcaaatattattatcttaatcttattctgaattttcaccactaaaaccacattctattgaaggaatatataataaaagtgcattatcatatagtgtcacaatgagggattcaggtgcgaagggaagactcattcctgtgaaaacatagcccatccccagcagttggtagaaggatttgctggagttcctcctctttgtgtggcctataaaacattccatgaggcatgtggcaatagtcacaatgatagtggtcttatctcctccagtcttagcatcctcactcaagccacctcttttcatagacacatactttatgtttgggaagaggtgctctaggtgggacaccctgcctgctccaaataattcctactgacatccatggccgcttcattctatctgagctggagatttgggatttaggtgggcacgnagnaannaggggtttggggccagtgtcgtttggatgattttgnacagatcttcctgggggtaagagagataggtgggtctaatcanccagggaataaaatgccaaggtgtgtgtatatggaaaatccaagggagaggaaattaaaattatcccagattgcttatttaatagtcaggaaactcaactttcccatgnaaggtaagattcccccactgtgtcctttttctttttccctgagaaattgnaccaatttcctgcagtcagatgcaaaaaatcacaggtggnctgggtcgcaagtgagncttcatgtnctgtcaaacctnagtcactttgggcaggcccaaggtcaggtggcat

SEQ ID NO: 463 - DNA, 2642 bp, Homo sapiens
cccccgggctgcaggattcggcacgaggtgacgtttacatagcgtgcagggatggctggccaccccaccctaatcttattatgcaaatgggctttccacctgactggcgcaatctgtgagccctacctaaatcaaacactgcctactcaagcctgcctataaaatccagagaactccaccagccgctctttccttttggaagcccctctttccttttggaagcccctctctctcactagagagagaacggttctcctttctctttcttttgcctattaacgtcctctcctaaattcctcatgtgtgtccgtgtcctaaatttttttggcgctagacgacgaagcccgggcacttaccccagacaacaccaccacttcaatagaatgtacaggccccgcaatcccaatcttccccaggatgtagaaacccagagcagagtgctttgggggtcccctggcggtggtaggatgtagggcatgcacagacaaatcccatccgccacacgcagctttccctttaccttgggagatgcgcttgccaggaatcctaggcttcttttgtgtcttgtttgtctgtattacagttgctccacttaatttgttgtgcatgtgttccatcttaccagactggtgcaagtgttggaaacttcagattggtaactggtgcacaccaagcctgcttcacagtagtgggtgccaaggagctgctaggcctatcctgtttcatccgagaggaaaacctcactaatccttttcctatttctaacttttttcttgcttcagtccagagaccaaaattaaaatgtaaaaggtaggattctacaagacaaatgctgttttttgtttctttgttatcatttttattattattgtcattattgttatcctataacttgtcattttcaagacaacctttggagagaagggggaaaaaacacatgggctctgatcccatctcaaactggaaccacactttttgattctcagtgtagagctcattagtgctgcctgggttacttccatcagcaaaaacaactctggtctaggacttcctaaaataacagaggccagaaactcttttcctgagcttgccaaacttgtgcgtttccatgactttgaaaatacctgtgctttagcctggaacactcttcctactactcttgcctacttaaaaaattctaacttatccctcaagtctcagatgaagaagtacttgttctatgcagctcccacggattcactcagacagcaagtaccacagagtcagtatttttcaaaataatgcctgagagttccttagatcagtgagtcatgtccttccctgcacaccagctaccaccaaagccaagccaataaagcctcgtgccgaattcggcacgaggaaaaaaaccctcaaaaaatgactgaaaacttctttaaatgtgtgtttgaaagagacaaggaagctcttcgtaaaatttgttcagttaatctaactgaggcccatttaaaaatgtaccaatcagcttatatgttaaatatctaagaaactgcatttaggkttttctcaacctgaatctgcagactcaagctatccacatacaatttgtatgagcacaagattagcaagccatactgctctgattcatctgattttaatggaacccttggggattgactcaatgcagctgactggttttttcctatattaaattgtccctaatgtgactggctacatcataatattatagactatggactatttgtcatagatgtttctatgtttgcttctctgcaaatttaagaaagttaactattttcttaaagttttgatttctaatttctcgatttgggcatacgaccaccactagcaaatgtcatcagagtacaaaaaatggaaacagaggctatcattaataatacattacttcactattgacgggatgaccgtgggttttgaagcttatgagttcaaaagtcctctttaaagtatttttcaattctgctcccgaagtgggtgagtgtgtgtgtgcacacatatgtgtctgtgtgcatttgtacagaggtttcagcctggcttacatttagcacagtagcttcctttacaggagactttttgcgagcatcagtgtttcatttcacaactcaccatgtgtactaatgctaaagatacagattacagtgtaagaactggagtaattatagccttccaaatcctaaactctcaaacttccttatttcacagggcaccattagtttacttccccaaagctgatttcagcattttagcagatgttttgtgaatgttgtaaatgggtacaaaatggaggacatcctaatgttgagagtagtaaatatcattgtcatgagcctaaggcttctctatacacattagaagaaagtactctctaaagagaatggttagaagttaacagggaatacatcactattgtaataatcataaaaaagcaattgcacgccagtgttagacagtctctgggtaaccaggtgctaataattttactatattaatgaagacttcaagtcatactggtctactcatttggacagtatttgcttcagcactaggaaggctgatgtcttccttttaaactcgaggggggggcccggtacccaattcgccctatcagtgagtcgtattac

SEQ ID NO: 464 - DNA, 748 bp, Homo sapiens
ggcacgagcgaaactgttttccaatgtggctgaaccactctgcatttccaccagtaatgagaatgagagttgctgttgctccacggcctcaccagcatttggtggtgtcagtgtcttggattttagccatcctaataagtgttagtggctatcattgttttcatttgcaattctcttacatggtgtkgaacatctttccccatgtttatttgtcatctgcatatcttcttcggccagttatctgttcagatcttttgcccgtttttgtttgcttgcatgtttgtttgtgtttgattttttaaagaaagctttttttattattgagttgtaatagtgcttgtatagtgtggataacagttctctatcagataggtcttttgcaaatattttccccaatctgtggactgtcttctcattcttttgataaatggctttaaaataataatctggccgggcgcagtggctcatgcctgtaattccagcactttgggaggccaagggcagatcatctgaggtcgggagttcgagaccagcctgaccaacatggagaaaccccatctctactaaaaatataaaattagtcgggcgtggaggcacatgcctgtaatcccagctacttgagaggctgagacaggagaatctcttgaacccgggaggtggaggttgcagtgagccgaaatcgtgccactgtattccagcctggacaataagagcaaaactccatctcaaaaaaaaaaaaaaactcgag

SEQ ID NO: 465 - DNA, 297 bp, Homo sapiens
ggcacgaggtgtgtttgtgtgtgtgtgtggtgtgtgtatgtgtgtggtgtgtgtatgtgtgtggtgtatgtgtgtgtgtggtgtatgtgtgtgtttgtgtgtgtgtggtgtgtgtatgtgtatttctttgaatgagaaattggctcccatgattatggagctgacaactcccaaggtctgcaggcagcaagctggaggcccaggagggccggtggtgtggctgcagccagtgtctgaaggcctgagaaccaggagggcgggtggtgcagctgcagtgtgaaagccggcaggctcgga

SEQ ID NO: 466 - DNA, 1681 bp, Homo sapiens
gaattcggcacgagtcgagttttttattcctccactgagaatcacacaaaaagttagaagcacaaaaagtatgatgggtaatgatttgctccacctcgtgttcttgcaactaagtttaggtgtagcatcagggggatggattttgtggccactgaggagattgggtggtgcccatacgagtaaggatmcaaataaaaatggmcacsytgtgcattgcttggtcattaccaatgagcctctagtttccamcaagaagattgggctctcttctcctcacacttgtccatcaactctccaacagttttgatccccactgtaattaaactagtatcttctaaacacaaaatcttcactctacctcagtagcgcttggcagctgaaatcttttctatttagaatatcccacctttctatcttgaaattttgtccaagctaaatgcctcctactaatctctgcgtacctgcgggaacacaatgtggctaccacattggctaccagggctgtagggaggattgtctcaaaatcctctccatttatcacaraaagggaggcgggaaraggaaraaagtaggttatgccctgaggctcaaggctactggatggccaatctgtgctaggtttgctggtcagaaagtaggatgatatgagctgatatagsagagaaatatagggtacagtttctaccctgaggggctgtattttagttggggagatacatgcaatgactggacaccaccaccaaggataaggaagtcctgggattgtgtgaaagccacagcagttcagagaggagaaggaaaaagactccatggaaatgatgggaattgaaccaggcctgggttttccccctctcaggcacactggaggctgtttgcctaccctgttgcatctcttggcttttccaagtttctgtcttgttacagactctttcctctcttcctcctcctagaaatattggcaagcttctttagtcatttgtgtttctttacattacaggccagaggtgtatcttctctgatagataatggccctcagttaagactagggaaagctattttgcttgctgtattagcgccctattttagaataatcctattcccttgattctttagtatttacaatttttctaagtaccgattatattttctaagtcaaagtggggtaaaattagtgcattgtatcctgttgttgccgctttctggagtagtcagtcttacatatttgaacaataccaccctggtgtaattttaaaaagtaagagcttgattctttaaaaaacacttagccaggcagtgtgagctctctctgaggatcctcacattaggagtgttttacatacatcacacaaaaggaaaatgcgttctgaggggatcggggctcctccgagctgagagctggacctgatgaattgtgacaaatgggcctgtttctgccagctgcacgttctcagccaggtgacgtctgaggctgcctgccagtaatggtttgtggtttggggagcaagagggaggccctggacatactcactggtggggaacaggaaaaagtcaggcccaatcagaaatagtaactctcctcagtgttccccagctaagtaagactatgcatttaccatacagtccccatcctaaaactcatgaaatgaagaattagtgacacactgggggagtagtggctcga

SEQ ID NO: 467 - DNA, 607 bp, Homo sapiens
ggcacgagtttcaacttgagatttggaggggacagacatccaaaccgtatcattaaatttaatagttttatgcagtttttttggctctagatctgtttagactcctgcagtcaggtgtctgtaactagcctctggtcctttttgagagttcacagtttggtgcaaaccctttggatgtattatttgggaaaatgggatatctggcagcctgtgtccctgctttacattatcctttttgctgcctgccccagcctcctcattagcatccctgccaaggccagtggagaaggatggagatgcggtgacattcagctgacagttgtcacagattgataatagctaacagcacatctctcccccggctccttccctagtgcaccaattagcccagcctcatctgcacctgggactcaagttgcctaaacatatttcatttcccatagcagaagatgccatccatctagagtgagactgaaaatacaaacaattcagaagttgtgactttccatgctctgcacacagaggctaccaaatgctaagggcgcttcctccccagcaccaggcttatggttctaagctccagaaaaatatcaaataaaccctgccc

SEQ ID NO: 468 - DNA, 1894 bp, Homo sapiens
ggcacgagcagtctacctggaaattgtcacattatacaaatgtcaacttttgtgtgtgtgtgtgtgttttgttttgttttgcggtcagaggcaagggctaaaagaaagcaagatcagagaaataccaagaggtgtttactgactaaagggcaaagggatctatcagttaaccaaagcaagataaatagaactgccaattaactttatattctcagaagcagtgagcaaagaacgctgcctgaacaatgaaagtgttgctgcaactttcatatttgctgttgtctgcatgtaatttgtttccttttacatagaaatatgtggtattaacagagggatgtgattagaataccagcggaagctctctttgataggagacacacaggcaggtgcctaacagcctatggagatcaggacagtttctctccagtaaactcacaaattgtggggaccatgatctgcttaataagtaaaagggcaatggggccaagattacaatgttgaaaacatccaggcttcccacctggagtcctggcctcacagtaataataagaataaagatgtattgagatatatctagacctaactatataaatagacagatagatatacacacatacacacactgtgctaagatgcttcacatgaactccctcatttcaccctcaaacaaccacagggtagatggtttatcaccgttttagagataagaaaactccagttagtacgtcactgaagatctacacagtgacgtagatgttgtgatagacatttcttaaaaatattccaattaatcctcagaacacctgtgagaagtatactaaatatactaagctccattttatgaatgaggaatcagagtcaaggagacgagataacatgtcccaggtgacggtattagcggtcatagcaggatttgagcccagctctgtctgtcttcaaaactcatgtttaggagactcttctgctttccaccaaagcccttgatttgaacctttgctctctcctgaatccacacttctcctgaaggaggagcaaggtggagatgggatagggcacaggatggctgactctctgactggagggcctaagaaaccccactttgacacacacacagaaaactgtgccctgggtgggggtgtggggcttcatgagaaaatcaagtagcaagagagagtcttaacatgcttagatggcatgtgcctgttctcctgatttaatggatgagaaaactgagatccagggcaagggcagtgagatagtgagggtctcttagaatgagtacagccttcagggacccaccccatgtacccgtgggatcaagacgagccagaggatacctcctaagtaagaacagaaggaacagaaaacccttaaggtttgttgttgttgttgtgacagaatctcgctctgttgcccaggctggagagcagtggcacagtctcggctcactgcaacttctgcctcccaggttcaagcgattctcctgcctcaccctcccgagtagctgggattacaggcacccgccaccatgcctggctaatttttgtatttttaatacagacgaggtttcaccatgttggccaggctggtctcaaactcctgacctcaagtgatccacccaccccggcctcccaaagtgctgggattacaggcgtgagccaccgcacctggcctgaaaacacgtatcatacttgctatgtgccagacacaattctaaccacttttccacagattaactcagccttcaaacaatcctaaaaagtaggtatgattatttcctgcattttacagccaaagaaactgaagcacagagagattaagaggacttgtgcaaggtcatggagggctatagtcctaccctctgaagtaagttaaaccctctccagaaaaagcc

SEQ ID NO: 469 - DNA, 1355 bp, Homo sapiens
  misc_feature (1327)..(1327): n equals a,t,g, or c
gcccctgctggatggcactgtgggtaacctgcatcctttcactgtgcacatggttctcatgcctttacggagcagactccttggcaaataaatgcctcagtgcaggagccacacgcaaggcatttcccttctgtgtcctctttcgtgatcttgaggtgggacttgggtttgaaggctttgtcactcacctggcatgcaaactcttttgttattgtgaactctctgacagtgctttaagtctggggcacgaataaataattttccacacagctcacaactgtagggcttacatccagtgtgtgtgcgttatgtctgtgtgtgtatccttatttttttgagacggagtctccctctgtcacccaggctggagtgcagtggcgcgatctcggctcactgcaacctccgcctcctgggttcaaacgattctcctgcctcagcctcccgagtagctgggattacaggcacccaccamcacgcctggctaatttttgtatttttagtagagatggggtttctccatgttggtcaggctggtctcgatttcctgaccttgtgatccgcctgcctcggcctcccaaagtgctgtgattataggtgtgacacaccacacccggtcctgtgtatgttttgagacggagtctcactctgtcacccaggctgaagtgcagtggcaggatctcttctcactgcaacctccacctcctgggctcaagtgattctcctgcctcagcctcccaagtagctggtatttcagacttgcaccatgatgcctggctactttttatatttttagtagagacggagtttcaccagcctggtctcgaactcctgacctcaagtgatccacccaccttggcctcccaaagtactgggattacagacatgagccatcacgcccggcccctaagtggatttttaggcattctttcaggtgggcctctgtggtgaaaccttttgtgcacatttcacaaacggcttctccgctgtgtggcatttctcagctttctccactgccttcacaggaaacttcttcccgcactcctggccgacgtcgctccctaggtgactgtgcggcaaaagctcagacctcaggacactggtggctgttgtccagcctagtgtctgcttaccccgcactcatcccgtagtcacacgtgaaggcttgaggggtctggaacttcctggccgtagcaatggactttctgaactttcttgctctttcagaattgcgttttgaccctgagtgtggtcgtgggtgactcgccggcctcccgccccggggtgtggtgcctttgttctgagtcatcacaagtgccatcatcctgancctagcwtctttcagatcaccctctcga

SEQ ID NO: 470 - DNA, 802 bp, Homo sapiens
  misc_feature (23)..(23): n equals a,t,g, or c
  misc_feature (40)..(40): n equals a,t,g, or c
  misc_feature (56)..(56): n equals a,t,g, or c
  misc_feature (59)..(59): n equals a,t,g, or c
ctcacttaaaagggaacaaaaanctggaagctcccacgcnggttggcggcccgctnttnaactagtggaatccccccgggttgcaggattcggcasgagagaagaccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggctgtatccctgctgttctggatgctcctgggggcagtgcctatagctcagggtcatcctgagattcagctcctggagtctgagagttgtggccacagcgcagagggtccttggcgggggggcctgcgctgtccgctgcagcctgggctctgagcagtgctatccctagaccttactcaggggatcctctgaactctggccctgccctgcagcttgagctatttttgcacagctttgcggtgcatggcttttaaatggctccataagcagcaggctttctgcggtgatttttttttccatctcacaccgtatcccctccttgtctcccctcccctgtctccgagggtccatctctctgggtctcttcttgtctctcctcacctcctcccgacctttctgcccttcctcatctcttggggcctgaccctgcaggctgaggctggccgcatggagctcga

SEQ ID NO: 471 - DNA, 1382 bp, Homo sapiens
cccacgcgtccgctgaattgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcaaaaaaaaaaaaaaaaaaaaaaaaaaaaaaaaaaaaaaaaaa

SEQ ID NO: 472 - DNA, 791 bp, Homo sapiens
cccacgcgtccggttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaagagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacgtgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaaaaaaaaaaaaaaaaaaaaaaaaagggcggccgc

SEQ ID NO: 473 - DNA, 2163 bp, Homo sapiens
cgcccacgcgtccgaggcggcggagccccagccccacccagtgcggagcgcgccgcgagccccgccgyaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgttttaaaaaaaaaaaaaaaaaactcgagggggg

SEQ ID NO: 474 - DNA, 1979 bp, Homo sapiens
  misc_feature (968)..(968): n equals a,t,g, or c
gctttgccagggctgagccgggctgcctggtgccctcaccgcccccgccawacaccaccatgcwgactcccggcctgcggaactcgtagtgcagcccctgtcgcctccccggcccctgctatcccacgcaggactggcttcggccgccggggccagcagcttgcracgtgtccctggggaggcggaatcgctgtgcgccctgagcccgggctcagcccttcgctttccagctgcgtcctgctcccggccgsccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcagcctgtctacgtcccctttctcatcgtcggctccatcttcattgcgttcatcatcctgggctctgtagtggctatttattgttgcacctgtttgagacccaaggagccctcgcagcagccaatccgcttctcactccgcagctatcagacagagaccctgcccatgatcctgacctccaccagccccagggcaccctcccggcagtccagcacagccacgagctycagcttcacaggcggctycatccgcaggttcttctcagccatctggtttcctggtgtcaccccagtatttcgcttacccccttcagcagragcccccactggctgggaagagctgtccagactttcagttccagktgacacgcccaggccatgaatycacaactcagtcagatggcagacaggtggagccctgctnccattgccacatgcaattctgagaaaatttcccttgtaactgatcagtgtcwtggaggagcatgctaggaaaacacagcaccttctaatttgaaagttcctgtctccaatcacagaaaggctaaaccagagaactgtttctggttttgcaaacatgtgatcattacatttcaatctatgctacttttattcaaaatatgcagcagtttgactttaaagttgcaaactggctaaaaacgttttactggacattcagctatattgcttagaaaagggctacatgtttctttttcatataagttgttcattgagttatgataggaatatattcataaataagcaaagaaaaatacctaattgtaattatcaaaggttcacttaaaaaattaactattaggtaaacttaagggggcagtgaaaaatctatttatgatttcgggagtaacctaaccatgaataatattagcatwatgagamcatttmctttttaaataaatamctaaatttkgtttacaaymggagttttyccagaatacaaggttycaataatcacatgaggagtttaaagttttaaatatatactcagacattcattgtaacacagagtgtatgtaaaatcatttcccccactcactggagggagtatttattgcagactttttgttcagcaacatttagtgtttcagtgaaagttggacagttggggcttaaaacatttatttgtaaaatgagctatgttcaaatgtaaatatttgtaatttaatgtatttaccmcattgactgtactaattatttagtagtcatactgtaatttttatgttaataataactggagttcaaagtctagctattggtataatcatctaatattatatatatctccagtgcccctgaattttatgtttgatgactatatatttgggcatatatcttgttggattagaataaataaaacactttatattttcatgaactctaaaaaaaaaaaaaaaaaaaaaaaaaaaaaaaaaaa

SEQ ID NO: 475 - DNA, 2087 bp, Homo sapiens
  misc_feature (1)..(1): n equals a,t,g, or c
ncccacgcgtccgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatttgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatggacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtggcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttccttttttttttatatttgctttcctttctactgcttttagatttgcaggagatgcaagtttcagctcaatgtttggcttctctcaatatggaaatt

SEQ ID NO: 476 - DNA, 1811 bp, Homo sapiens
  misc_feature (21)..(22): n equals a,t,g, or c
  misc_feature (37)..(37): n equals a,t,g, or c
aactaagtggttcccccgggnntgcagaatttsggcncaagccagaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgccctggagggcagctgctgcacaatggcacgtgtgtgcctcccactgcctgcccctgcacccagcattctctgccctggggcctcaccctgaccctggaagagcaggcccaggagctgcccccagggactgtgctcacccggaactgcacccgctgtgtctgccacggtggagccttcagctgctccctcgttgactgtcaggagtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctgcctggatctgaatggcaggaggcctgtgagagctgcctctgcctcagtgggaggcctgtctgcacccagcactgctccccactcacctgtgctcagggcgaggagatggtgctggagccagggagctgctgtccctcttgccgcagggaggctccggaggagcagtcgccctcctgccagctcctcacggagcttygaaacttcaccaaagggacctgttacctggaccaggtagaagtgagctactgcagtgggtactgcccatccagcacccatgtcatgccagaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccaggggacggggtttcgccatgttgcccaggctgttcttgaactcctgggctcgagtgatccacctgcctcagcctcccaatgcgctggggttacaggcaggaaccactgcacccagccccctgacctcatcttttaagcaaggctgacattgctatgcaggcttgttgggtggacttggtgagggcacgcgtgtgaagtggctggcaggtgcctagttctgttaagcacctgccatatgataacctgaggtcccactgtgtggcagatgaaggggaaacagaggtggaaggcacccgtgccacctgggtggagcacagtggaaggcctggtgttggctctgggcgtcctcctggcaccagcctgaccactctgcctctcttactaacccatctctccctcacgtgtcccctgggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaacaaaaaaaaaaaaaaaaaaaaaactcgagggggggcccg

SEQ ID NO: 477 - DNA, 642 bp, Homo sapiens
ggcacgagggggccaccacacccggcctgtacatgctgttttgcatcttgctttatacgttggggagtgccagatgtcaccatctttcgttcttcctctggggctggtcaaatccccctgagaaaactcctctggcctcctggcggggggtgaaggccaggctgccagggccaggctgccagcttctgggagctgcaggggcagaggcagggagctgtcaggcattcagccagcaagacgcactcagtacccacttggggttcagaatccccctccctcatcttcagatgggccagatgtccccaaagccagcggcccctttctgtttcaccctgtctacagaataaacccccagtcactgggggtgggggaagagtaaggggagaggggaaacgagatttggaggtctagctgctgctgaaacagccctcagttcgtctttattttgccttctgcaaaactggcctggtgttgccagctccttttgaggactttgctaccggttctcagcatccctcaattgctggcttaggattcatgggtttttaggggtggggtgggattagcatgtccagctgctttccagtttccaaagttctgtccctatcatattgcctctgatttaaaaaaaaaaaaaaaaaa

SEQ ID NO: 478 - DNA, 606 bp, Homo sapiens
  misc_feature (9)..(9): n equals a,t,g, or c
  misc_feature (19)..(19): n equals a,t,g, or c
ccccccggnctgccaggantttcggcacgagtctctctgtcaactctatttgtatttctataatggaaactcaaatttgcctaactcagattgtagcacttttcttcctcaggctagtcctaggaaaactcacttgttttttgtatggaaaactagtgttagtagaagcctttattcttgcatagcccccaaatcagctttttcagctataatttagtaagtctaatgtgttcgactgaagtactttttttttgtaataacaagtgaaaaataatgaagagtgtgtcctggcgcatggctcacgcctgtaatcccagcacttcgggaggccggagcygaggcagcggatcacttgagggtcaggagttcaagaccagcttgaccaacatggtgaagtcctgtctctattaaaaatacaaaaattagccaggtgtggtagtgcatgtctgtaatcccagctacttgggaggctgagacaggagaattgcttggacctgggaggcggaggttgcagtgaggtgagattgcggcattgcactccagcctggacaacaagagtgaaactttgtctcaaaaaaaagaaagaaaaaaaaaaaaaaaactcga

SEQ ID NO: 479 - DNA, 1118 bp, Homo sapiens
  misc_feature (482)..(482): n equals a,t,g, or c
gataaattttgaacaccaggactctgaaaaagtttaagcatatatatgagaaatttcctgaaatgttgtatgtattgtcttgtcttcttaaacagaagacactgaacagaatggaatctttggttgatctctaaggaccaccattttgaggatctcttataatgtatgatgacatttttcggttcccacattttgctttttctgttttgccctttgaaagcaggccatcgtcatttggtcagttcctcctttcttactgtggctgtgtccatctctaaggggccattcttccactctacagctcaaaaaagaaaatccaggaaacagcttcccaggcctgccttcctggtccccctcagttcccaaaacacacaaaccaggacaaaacaccacttcagttttctgcatcttatagtcttacaaccttgagtttgggaggatcttgactcaagagtcagatggtgaaatatctagtacttganccccttgtgtgataatgtcaagagaactaaggtttggtcccagacccaacaataactaccaataggaatctgggtagcatcttttaaattctttagtcttcagtcttatctgtaaaacatgggactggtctagataatttctccaactccaaaattcaatcatgttcttaatattaaaaatcctcatgtccatagatttttgtattctctccctggtaaatcctggtaatttcacagggatgtttgaaactgaaaaatcctgggaaaagtagattttagtcaagtccactccaatttaaaaccatactgaagtaccattttcactcataattataaattaaaaaatgacactatcgagggttgataagattatagagagatggctattttcatgttgccagtgagaatataaaattcccatttggggaaaaaatttatactatctattcaaaagttatatgcacttaatctatgacttgacaattccatttctcatgttcattttggaggattactgacacatatcctatgcaagaatgtgattgatagcattgttttcatttgagaccagcctgggcaacatagtgagaacctgtctctacaaaaaatttaaaaaaaaaaaaaaagggcggccgc

SEQ ID NO: 480 - DNA, 830 bp, Homo sapiens
ggcacgagtaaggactgtgttctttatgcatttcttgatccaggcatggcagttcctcttttcctgtacatattcacactcctgccacttctaccctttctcttatccctctgcttttcacctctgactgtaaaaagaagtagcagttccgaaagcaagagttccctatgaacacggaagaagacattggcaacttttgagtacaacaactatatttaatagagtaatttaagaacatcagccagtgaattttatacaagatagtgaaagagaaaaggaagattaattaggggtagtttaggatgccattaaatagcctagaattaggggagtagtcgttgaatagaaaggaggccacaaatttgagggatataagctaagaattggtaagccaagaagaaggaaaaggtttgggcagtaaggataatgaggaacaaaatagagaactcagaagcaatatctgactgttatcattggaagaatttttttgcttgcttgaggctggatattgaagtggatcaggatacttgagtgactatctgatgggcttttggaactagctctcaagaggtgaaaattagcttttttttctttttctttctttttttttttttttgaggcaaggtctcactgttgttgaggctgaacctcctgggctcaagcagttgtcccattgcagcctcctcagatactctgtaagccaaggcagggggaatattttgtgctcagtagtttgaggctgtggtgagctaagatcacactgctgtgctcacttcagcctgggcaacacagtgaaaccccgtctccatctgtttaaaaaaaaaaaaaaa

SEQ ID NO: 481 - DNA, 755 bp, Homo sapiens
  misc_feature (640)..(640): n equals a,t,g, or c
ggcagagggaaatgcataggcttgtaatgataattaagattcaatctcactctcaatgagatcttgggattcctgcaagtttgaccttcacttatgcaatctgtaaaatgaaggcattgggcttagatgacttagatggtttcttcagtgtcttacaggcttacatgttatatttttgaattgctataaagcatgttttgcaaattctgacaccaaacaatgttttgcattcctatagcacagataaaccatgtttatagtagccttactcattctccattgggccttaggtggtacagtgatgtccaagtgactcgtgacctctcacttcttccacttttccaggtagaagatcagccttgctcagcctcctgggattaggagatgttttaagaaaaggagaatttgcatcaaagttctgacattgtttgaggaaaagaggtagatttcctaaaaattcccctgaagcccataggatatattctcttcaaaataatgagtgggccgggtgcagtggctcacacctgttatcccagcactttggaaggccatggtgggcagatcacttgaggtcaggagtttgagaccagcctggccagcatggtgaaaccctgtctctactaaaaatacaaaaattagnccggatgtggtggtgcatgcctgaggttgcagacagccgagatggtgccactgcactccagcctgggcaacagagcgagaccctgtctcagaaaaaaaaaaaaaaaaaactcgaa

SEQ ID NO: 482 - DNA, 1939 bp, Homo sapiens
gaacacaaacatgcagtctgtagcagatggtaataggctgayatattacacttgttgatgtaaatctgataggtttctttctctccaaggacagctttttaaatatttaacagtatcaataatttttcagtttctgtgagaattttataatttataatttgcagacttaatgtataatctattttgtcctaacaattacaaatatattttttatttcagattrtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaycctcaggagatcctgaaacyagtcccccatggatactgagggctgactgtatagtcctatcctcacggaactttcattctaatgrgggaagactgactataaacaaaatatatgtaataggtggtggtaagtaccgtggagaagtaacaaatggggcaaagtgagttatacagctccatycttagaaaccttggagtacttttcttagtttatactcgtggtggtttccttttgtctcctttattacatgggactctgacatgtgcccatagctagggtggcagtaggatctacccgaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcrtaactctgatggaattgaagtcatgaggcagcagagagcttaaattasagctttaaaaatttttattttttagagggaatttamttgggagtaacagcagtaatagttaacggagccagaatgcttgagtcatataattgcaaagcagagttgggagcaacagatgctaaagagtagttgctgtagttcctctttgggtcgtaggagcagttgtcatrttmctatayagctactgcatgaagaagagttcttagtgaggcctgggtgaacagctcttcttagtattctgtgtgaccccattygaccttttaacaaatccctaagtaaataaatagcccctmaggwaaactaagtttttctctgctgtttttttgcttgagagagctataactgtaatagacttatatttctgaacattttagtgcttgccaatatttggtaatatttatgtttcctatatttgtaatgaacattcttcttcmggtacatttyttgttaaattattgtttsatgsataaaagttcaccttttattgtataaaattgactcagattaatttatacacattgacaatgggtaaatagagtttttcagattattaaaagctgaaggatgcccatgtaagcaaaaaaaaaaaaaaaaaactcga

SEQ ID NO: 483 - DNA, 1776 bp, Homo sapiens
  misc_feature (9)..(9): n equals a,t,g, or c
  misc_feature (24)..(24): n equals a,t,g, or c
ggcagaggnagacgggggtttctnccatgttgcccaggctggtctcgaactcctggactcaagcaatccgcccaccttracttcccaaagtgctgggattatgggygggtgtragccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttktttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccaatcctacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaaaaaaaaa

SEQ ID NO: 484 - DNA, 682 bp, Homo sapiens
  misc_feature (624)..(624): n equals a,t,g, or c
gcaaatattaattgccatttactttgaaacctaaaatggtcaagattccattttcctccaggctaataaataataatttgcaatatatagattgtattttgtctttgaaacgctgtgaggagatcctcttaatgtggcatggtctgcttctatgccttgcttctgtgtttcttgagctccgtggagataggccccctctcctggcttctctgcttgagccacataaaatgccacttcacagctcttccctttgaagcctgatccagtatgcatttggagctaattactgcagttgacacaactccatctaaaagcgtcatgaaagattctgtaatcactgataagaaaatgatcttgcaaattattgctgtgtcctcctttattgcctctttaccttaacagtacagtttacaataatgtaaatttttttctaatctttcaactttaaccctagaaattgtagatgttttagcagtggttatgtgatattggcacaacataactatataatttgctcaatattgtggtgcatacctgtaatcccagctgctcaggagtctgaggcatgagaatcacatgaacccaggagatggaggttgcggtgagctgagagcgagtcactgnactccagccaggacgacagagtgaaaccctgtctcaaaaaaaaaaaaaaaaactcgag

SEQ ID NO: 485 - DNA, 739 bp, Homo sapiens
  misc_feature (649)..(649): n equals a,t,g, or c
gctggactcagagctctaacgacagctgcctcaaaaagaaaataacatcccttgttcatgcttgccagaaaacggcagcagaagcaggcccaagggcatcctctacctcctggcattcatttttgcctctgtcatctcatgcaggtgtgtctgcttggtggaaactgggtttcacaacagagtccaagatgtaaaggagtttggaaaatgtctaatgtggcttttgatgtatgtaagggaaatatttaaggcaatcctattgtaaatgagagaggataaagggatacaatgggagttaagtgtgctgcagttcactcgaactggtaaaatgtcagccccagttgactttgataaattatgcatatgccagctgccccagtcacagtcttgaagctcttgccctttccttgtgtgtgtggtttaggatgggttcccattggctgtgtttccatcccatctcatctcaagggaaatctctgctgctcctgagcacctcgtgtcatagattttatactcttacagacttggaatgcagtagaggtatgtggawttttaggggtttgtttttttaagaataagtaacaagaaataacacatttcttaataatagcttttttgacatagtttggagtctgattatatggtacanttttctaccagtaatatagggttgccaataaatagaaaakgttttctaaaaataaattttattacaacaaaaaaaaaaaaaaaaactcga

SEQ ID NO: 486 - DNA, 1126 bp, Homo sapiens
ggcacgagattgcctacaaatgtcagaggtataatggtttggttttcatgctggcttctcacacagtccatcacagtgattcttggagccagagggaggtatggaagactgtgtgttctccaagggaggcactgtggtctggtggataagagtgggagtcccaatcctttctccgcagatgtgctagctgtgcactctgggcaagtttctcactctcctgagcctcagcgtctttatcaatatgacgagaataaatacagcacctgcctacctcatggggttgtttcagcagtcaatgagatcatgtatatgaagcatttagtatacctagcacctaataaaagctcaacaaccagtagtcttattactaacaaaatggagctagaaggatgcattagtttaaacaaaatcttgaggcagatactgggagtacctgtctttattcttcaacttgagtctcctcccagtttgtttggataaaaactcaaatgtaatatttttaatttgggtaaaagaacttctgagaaagggttgaacatctatccacttgcctttttatgcctagggaactagagatacttgttggcggcatcgcaaatgttgctgacttatgaagtactgcagtatctgaatacctttttgtaggataatctaaagtttccaaaaaatagtatagtgttgtagtgaagaacttggactcttaagccagattattttgttcagattcagaaatcccctccactccacccactggctgtatagccttgcccaaatcactgaatctctgtgtgtctgcgtcctggtgtgtgaaatgaggacaatagtagctattgggtagggttggcctggggtctaagtgatgactgcctgtaaggtgtttagaacagtatttggtaaacaactggcactcaatcagtgttgctgtgattatgatgatttattccaaggttgcttgctttccagtacatcatagactactacttgaccaaatttactagcaatggagtacctgaaagttttacatgtgcacatttgcatgaaaaccccacaaaatttccctttgaacagtgaaggggacggcacaaagataattcttggcactaagcttaaaaaaaaaaaaaaaaaa

SEQ ID NO: 487 - DNA, 851 bp, Homo sapiens
gctcccacagataattgagaatatgcagtatttggttttctgtgtctgctttagtttgcctaggatattggcttctagctgcatccatgttgcagcaaaagacacaattttattctattttatggctgtgtagtattccatggtgtgtatgtaccacattttctttatacagtccaccattgatgggcaccagggttgattttatgtctttaaatatgtgctgcaatgagaaaaaacatattttctacaaaatgatagaagtttaaaaggacaagtttatgggttagctaattggcttcccattttattctctaattctcttatattgacacttcttgagatttaatgttgtttgccaggaacatggtactggtattgtgttggtaaacagtaagcggtagaaacaatggtgataacatagattcatacacaatgtgcttttaattctttgaaaaaatagaataaattcaggagtgaattgctttgtaagttgttatttttaaaacttacctgcaatgaaagaggactgtcctcctcgcagaactagagaagggtgacaagccatctccctattcactgattggattcccagtgctactagttttgtgttactgaaaatcacttgagataattctgttctatgtgcaaaaaagcmaaaaagtagaatttagaaatccaggcctgctaatagctattagccatctatttattgttctgatttttttttttttttttgagatggaatctcgttccagcctaggcgacagagtaagacctgtctcaaaaaaaaaaaaaaaaaaaaacctcgtgccgaattcgatatcaagcttatcgataccgtcgacctcgag

SEQ ID NO: 488 - DNA, 747 bp, Homo sapiens
catacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcmgcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgtccgctactggtacagagctttagctaagcaaaatatcagtgtgtgattaatctttaacttccatttgtttttgttactaattttagattaaaattatgatacattaaaaaaaaaaaaaaaaaactcga

SEQ ID NO: 489 - DNA, 2520 bp, Homo sapiens
acgagcgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctgcttcacagtagccttgaaaatcaggagccttgaactacagtagctgtgaaaactgtttgcctaatggttactggaggggacagaatgggttcaaagttcctccaaagctccatccttaaagaatcatcactatttgacatgtccaatagttccctgaaatttccattcccaagcttgtcttcatttgacctgactcagagcttgctctgtgtgaatagccctattcttagggtgtgtgttgaaaacaatcagtagcagctgtttaacatcatagttgctggaaatagcaatattaattgaagcttacaaggggctgcccaaaaaacttaaaagcaaaatcccatagggggtatagaaaagctctaaaatattcctagagagtcacatgcatgagaagagctgtgcacatgcccaggaaagacctgagaaggtcctaatctctcacctctggctgatcttgaggctctgtgtaagcagagtgtgaaagctaaggcaaagtcataaattgcctgttgaagcatcaaatacatgcccccaaactcacacagcccctctgcaaaggttgggaaacttgcaaggaatttaaggaaatctctgttcagtcattagccagccactaaactaactgagcagatccttcagtgatcacacacaacaaagaatacagactttacagacttagtcctagaaaatcactacacaaacagcaacaacaatgcacctgggactaagggagaggagatgagttccagagttggtatattatttaaatgtctagttttcaataaaaacaattataagacacagagcaaaactagaaagtatggcccatacccagggaaaaacaagcaaccaatagaagctgtccttgaggaagttaatatcttggacttactagaaaatgactttaacactagttattataaatatgttcaaaaaactaaaagaggccaggtgcggaggctcacgcctataatcccagcactttgggaggctgaagcaggtgggtcacctgaggtcaggagtttgagaccagcctgaccaatatggcaaaaccctatctctactaataatacaaaaattagccaggcgttgtggcgcacacctgtaatcccagctacttgggaggctgaagcaggagaactgcttgaaactgggaggaagaggttgcagtaagctgagatcacaccactgtactccagcctgggccacaagagtgaaactccatctccaaaaaaaaaaaaaaaaaaaaaaaccctaaaattaaccatatctaaagaattaaaggaaagtttgagaacaatatctcaccaatacagaatatcaataaaaatataaaaattattttaaaagaaccaaataggaattctggaatttaaagtgtaggaactgaaatgaaaaattcactacgggggctgaacagtagatttgaactggcagaagaagaatcaacatacatgaagataggttgattgagatgattcagtatgagaaagaaaaaaaaaaaaaaa

SEQ ID NO: 490 - DNA, 1462 bp, Homo sapiens
ggccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccayggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaaaaaaaaaaaaaaaaaactcgag

SEQ ID NO: 491 - DNA, 1635 bp, Homo sapiens
ggcacgaggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccactcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggagccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttagaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatatattttttaataagatgcactttatgtcattttttaataaagtctgaagaattactgtttaaaaaaaaaaaaaaaaaaa

SEQ ID NO: 492 - DNA, 2079 bp, Homo sapiens
ggcacgagggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacctaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcaaaaaaaaaaaaaaaaaaa

SEQ ID NO: 493 - DNA, 2410 bp, Homo sapiens
ccacgcgtccgcttcgacgacgacacctgcagaagtgcggagcccgccatgccgcgccacctctcgggactgctcctgctgctctggccgctgctgctgctgctgccgccgacccccgccgcccccggccccctggcccgcccgggtttgcggaggctgggcacgcggggcccagggggcagtcccgggcgccgccctgtctctgctgtccccacccgcgcgccctattccggggccggccagcccggcggggcccgaggcgcaggtgtttgcaggagcaggcccttggatttggtgttcatcatcgatagttcccgcagtgtgcggcccctggagttcaccaaagtgaagacctttgtctcccagataattgacactctggacattggggcggcagatacacgggtggcagtggtgaactatgctagcaccgtgaagattgagttccatctccagacccactcagataaacagtccttgaaacaggctgtggctcggatcacacccctgtctacaggcaccatgtccggcctggctatccagacagcaatggatgaggccttcacggtggaggcaggagctcgggggcccacttccaacatccctaaggtggccatcatcgtgacagatgggaggccccaggaccaggtgaatgaggtggcggctcgggcccgggcatctggtattgaactctacgccgtgggcgtggaccgggcagacatggagtccctcaagatgatggccagcgagcccctagacgagcacgttttctatgtggagacctacggggtcattgagaaactctcctctagattccaggaaaccttttgcgctctggacccgtgtgtgcttggcacacaccggtgccagcacgtgtgtgtcagtgatggggaaggcaagcaccactgtgagtgcagccaaggctactccttgaacgccgatcagaagacgtgttcagctatcgataagtgtgctctgaacactcacggttgtgaacacatctgtgtgaacgacagaactggctcttaccactgtgagtgctacgaaggttacaccctgaaccaagacaggaagacttgttcggctcaagaccaatgtgcctttggtacacatggctgccagcacatttgtgtaaatgacagagatgggtcccatcactgtgaatgctacgagggttatactctgaatgctgacaacaaaacgtgttcagttcgcagcgagtgtgctgggggctcgcacggctgccagcacctgtgtgtggacgacgggcccgcggcctatcactgcgattgtttccccggctacaccctgaccgaagaccggaggacgtgcgcagccattgaagaagcacgaagactcgtctctacagaagatgcttgtgggtgtgaagccaccctggccttccaggagagggccagctcatatctgcagagactgaatgccaaactcgatgatattttgggcaagttgcaagcagatgcgtatggacaaatacatcgttgaattactcagatttttcacctggatatacggagagcttggtctatttaatatttttgcatacttcaatgttcctgctaataatttgccattgcaaatgctttaatattactggataagtagtatgaggatcttctagagaatcagtaggacataaacgttcacatccttaagagcaaactttagtgtctctaagctatgactgtgaaatgattcatggggaatagaatgaaaagtttggtatctctttatttaccaattgagccatttaatttttaaatgtttatattagtaagataaccattcttacaatgggaactttttatctattttctcttgatagtatttatagtataaaccagttttattattgagagtgtaaattatacaagtatttacacataaaaaagttcatataattgaggtaaatataatttagaactgtttctttaatgctttgttttttgctcactttttgctggaatatcactgaagctgtgatcaggggattataacacatatcaagatcaagtgaacactacatgaaatattgtaagaaacacataactaaagactttagttttgaattaagtgttataacttcttaccaagttttggtaaaaaatcctacattatctttactgtttcactttaggattcaatcaagaaaattatatacttataaatattgatctaaaaagttaacaacaaacccaatgtcgccattttaaagtttaagcttaacttttcttcacttacatatttagtatatgtattttatttttccgcttgaaagcttatagctcttaggagaaaaccatcctttaaattgtgactactcattttttctgtttgtattgtctttagtataataaaaagttactatctttataaaaaaaaaaaaaaaaaa

SEQ ID NO: 494 - DNA, 2131 bp, Homo sapiens
tcgacccacgcgtccgcggacgcgtgggcggacgcgtgggcgcggcctcccggcgctcggctccgaccccgccgccgccaccatgcagccccccagcctgctgctgctcgtcctcgggctgctcgctgcgcccgccgccgcgctcgtccgaatcccgctgcacaagttcacctctgtgcgccggaccatgtcggagttggggggccccgtggaggatctgatcgccagaggccccatttcaaaatacgcccagggggtgcccagtgtggcggggggtcccgttccggaggtgctcaggaactacatggacgcgcagtactacggggagatcggcatcgggacgcccccgcagtgcttcaccgtcgtctttgacacgggctcctccaacctgtgggtcccctcgatccactgcaagctgctggacatcgcctgctggatccaccacaagtacaacagcggcaagtccagcacctacgtgaagaacggcaccagcttcgacatccactacggctccggcagcctctccgggtacctgagccaggacaccgtgtcggtgccctgtaagtcgggtctgtcgagcctggctggcgtcaaggtggagaggcagacgttcggggaagccaccaagcagccgggcatcaccttcatcgcggccaagttcgacggcatcctgggcatggcctacccccgcatctcggtcaacaatgtgcttcccgtctttgataacctgatgcagcagaagctggtggagaagaacatcttctctttctacctgaacagggaccccggcgcgcagcctgggggtgagctcatgctgggcggcacagactccaagtactacaagggtcccctgtcctacctcaacgtgacccgcaaggcgtactggcaggtccacatggaacaggtggacgtgggcagcagcctgaccctgtgcaaggggggctgcgaggccatcgtggacacgggcacctcgctcatcgtgggccccgtggacgaggtgcgcgagctgcagaaggccatcggggccgtgccgttgatccagggcgagtacatgatcccctgtgagaaggtgtccaccttgcccgaggtcaccctgacgctgggcggcaaaccctacaagctgtcgtcagaggactacacgctcaaggtgtcgcagggcgggaagtccatctgcttgagcggcttcatgggcatggacatccccccgcccggcgggccgctctggatcctgggggacgtcttcatcggccgctactacaccgtgttcgaccgggaccagaaccgcgtgggcctggccgaggccaccaggctctagctgcccgcccgctggggaggacggggtccggcaggaggaggctggccgccccgccctcccggccacccctgccgcacacactcacgctcagactcacactcaaagcccagctctgcaggcgccgggctgtcgggctgccgttttgttctgtggtttccccggccttggtgtgtctgtctgtctagtagagggcggggtgcggggcagcagccactaggctgaccccgagtctggagccacgtcactgactgggaagccccagcctggctcggccgcccatcgtcttgcacgcgggaccccctcccccggcccaggtagttcccccccccccccccagcccgtgcttcgggggcctggctgcccaggcaggacttctggactgagcccccaccccaggccaggctgttctctgggcttctcctcctggggtctggtctggggtccagagcggggcactgctggcctgtcttcccgtgtggcccatcgtggaagggacccgccgaggcccaaggacaagcaggaagggcttggaagggtcgggactcagggacaaaaggcagccttgtgatgcctttggggtcctcctggggcttgaccccatctaggagggcatttgctggtgccgggttggggaagaaggggaggggggggctggtgccaccttctgtgagcttttcccctcttgagtgaccaggagccgaagtgaacgtggaaatacagtcgtctgggcctcaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 495 - DNA, 2048 bp, Homo sapiens
acgcgtccgggaaaggagacgctggtgatggggttaggaaaaagtgggactcctccccacgaccattgctattatccagatcatttctaaggattcggtttctgccatttctgacagctgcttgaggccgagtgaacgtggttttggaagattgcttaaacaaagaatggaggccagagtggtgcacgcattgcagaaaaggcaagtgtcacttctttgtgtgtttctgggagtgtcttgggctggcgcagaacctcttcggtattttgtggcagaggaaacggagagagggacctttctggccaacctagcaattgatctggggttaggggtggaggaactgtcagctcggggatgtagaattgtttcagatgagaccataggatttttactcctcaatccgcttactggtgatttacttctaaatgagaaattagaccgagaggaactgtgtggccccacagagccatgtgtgttgcctttccagttgttacttgaaaagccttttcagattttccgtgctgaactatgggtcagagacatcaacgatcattctccagtatttctagatagagagattaccttgaacatattagaaagtaccactccaggggcaacatttctcctagaaagtgcacatgattcagatgttggaatcaacaacctgagaaactacaccatcagctccaatgtttatttccatattaatgtccatgataacggggaagggaatgtttattccgaattggtactagataaagtgctggatcgtgaagaggttcctgagctgcgtttaaccctcaccggcttggatggcggttctccgcccagatccggaaccaccctcatacgcatcctggttttggacataaatgacaacgtccctgaatttgtagagtcgctttacaaggtccaggtgcctgagaacagccctgttggttccctggttgtcactgtgtcagctagagatttagataccggaagtaatggagaaatcgtctatgcatttttttacgctactgaaagaactctcaaaacgtttcgaatcaattcaacatctggcaatcttcatcttaaagccgaattgaactacgaggcaatacaaacttatacattaactattcaggccaaagatggtggagggctttctggaaaatgtactgtggtggtccatgtaacagatataaacgataatccaccagaactgctcatgtcatcacttactagcccaatcccagaaaactcaccagagacagtagtcgctgtttttaggattagagacagagattcagggaacaatgcaaagatggtgtgctccatccaagaccatctccccttcgtcctgaagccatcagtagagaatttctacaccttggtaacagagagagcactagacagagaagaaagaaccgagtacaacatcaccatcaccgtcaccgacctggggacccccaggctgaaaacccagcacaacctcacggtgaccgtgtccgacgtcaacgacaacgccccgaccttcagccagacgacttacaccctgcgcgtccgcgagaacaacagccccgccctgcacatcggcagcgtgagcgccaccgacagagactcgggcgccaacgcccaggtcacctactcgctgctgccgccccacgacccgcagctgccgctgggctcgctggtgtccatcaacgcggacaacgggcagctgttcgcgctcaggtcgctggatttcgaggcgctgcaggcgttcgagttccgcgtgggcgcggccgaccgcggctcgccggcgctcagcagccaggcgctggtgcgcgtgctggtggcggacgccaacgacaacgcgccgttcgtgctgtacccgctgcagaacggctcggcgccctgcaccgagctggtgccgcgggcggccgaggcgggctacctggtggccaaggtggtggcggtggacggcgactcgggccagaacgcctggctgtcgtaccagctgctcaaggccacggagcccgggctgttcggcgtgtgggcgcacaacggcgaggtgcgcacggcgc

SEQ ID NO: 496 - DNA, 2406 bp, Homo sapiens
  misc_feature (1934)..(1934): n equals a,t,g, or c
ccacgcgtccgcggcggcgaaggcaacaattaaggcccccaggtggactggcagcgcccgctgatgctactactgcagtctttattttttcccatgagctgggggtcgggtgggggagggaaagggagggatgaccttcctagggagaagcccacgacctgtcctgtctttgatcgcctctttgacatttttgccaaaataccactagtggaaagtcaggctagctgtgctcgtattggaatagcagcctcacactggcgtctggactgttctgtagatggaatgcaagcggactgtctgtctttaatctaacttattgctagagaatagggttttaagacgaaaagaaaactgaaacgggattggccctcattcagtgagttctgtggttccagtaaggatttgtatgtacatacgctcttgtcttacgttttgggtactcttgtctcatctgttttagctgtgcgtttcttttcagggtgtactcgaccagccatggactagtgtaaatcccgaacggacagacttggaacataaggcgcgttgatccttatggtttaggcctggccagtttcccgagtctcggattagctgacagtattaacactaaattgcagtttacagtatttctacatgacagccatacgtaacatcaagccattgattgtgtattttcctttgctagtttactttggctttgcatccgtagtcagccttatccaggttgggttttgctgttcgccgtctcccaggccacaaggcttgcctgaggggaatcgcagctccttttaggttttggtattaggtgcttggcaggtggctgtgggatttgtacccttcttcctcttaactcaaatccaccgcaaaaatgatgaatcactttaatagaaacgttaaacaccacaaaaatagagaaaattcaggtctgtatgtcattgattgtgttgatattttcagagaactcctgatttttaagctgccacgctccttcctcagggatcacgctgccatcactcttgagtgttccccgctggaccttctgctggtggctctcgggacggtggagacgccgttgagctggagaagctgggcagtcatcttgaggaaggttgtggtgcagtgtgtggaaatttaggtgctagaagcttactggtagaaaaacccaaaaggaagagaagagctcttctgttcataagcgctctgtccgatttcgggagcctcgtaagcatgtccgtttttcctccccggaaacactccttccctaagcagttgttgtaggaaaacgaactaaaggcattatcagataataaatcactcctatttgaccaagactttttctacattttttttttttctttttaatgaaagcatcaaagcgagagagtcctttctctcttgtacagttgacacatgctctggaatcgaaggaaactacgttgctgtttccacaaatttgttctcagtttagccttaggtccttcattcttattttggaaaaatctgtctgaaaaacgtgacctgtcgagtgtgtgttcagcctttctttacaagaccagaaacggtgtgaactcccgagatatggaggtaataacgccagactcgctttgttggttgctgcggtttagtcaaggagaggtatgaggaataattgaggaaacactgactgttgctttttgctctttaccagaatcggacttaagagttgggaaatgagtatgtgtgacaggatccaggtgaccgtgaggatgagaacagtgatgccctggagcatggcacagtctacccagcatgactttccttagaaggttccctccatacgctagagcaaaagtcccaattaactgaaccctagcagaactagaagagagctgtacagcttttgtgccatcaccggggccctaaagtcaatgccatggatgggaaattatgggggnttgggggggaggggtaggtggggctttccttaacttatcttcatgtccagtgagcagtgttttgtccttccttgtagcctttggaaatgatttactggaattacaaaacctattttttcttttaaatttcagctttggctctggctgctttttagaataatgcaagataacagttatacctgagggctaaaaatgaagagggaacgggagacttgatatttaagcagcttgaatggtttcttttcttttctttatttttaaagaaatgcacttgcctctgatactgtctctccagtgaaatgattactcctccattactctattgatacaatattgtgcatgctagtgttgtatttctatacagtagcttgaaatttattaacttatactgtaggtgttatgtattcctatgacaaaaaaaattaagtcttcaaattttaaaaaaaaaaaaaaaaaaaaaaaaaaaaaaaaa

SEQ ID NO: 497 - DNA, 1669 bp, Homo sapiens
ccacgcgtccggcacggtcgccaggcaccgctgaccgaggcctgctgggattccagaattggagagggaggcaccatgaagactctcctgctgctggtggggctgctgctgacctgggagaatggacgggttctgggagaccagatggtctcagacactgagctccaggaaatgtccaccgaggggagtaagtacattaatcgggaaattaaaaatgctctcaagggggtgaagcagataaagacactaatagaacaaacaaacgaggagcgcaaatccctgctcaccaacttggaagaagccaagaagaagaaagaggatgccctgaatgacaccaaggattcagaaatgaagctgaaggcgtcgcagggggtgtgcaatgacaccatgatggccctctgggaggagtgtaagccctgcctgaaacagacctgtatgaagttctacgcccgagtctgcagaagcagcacagggctggttggccaccaggttgaggagttcctgaaccagagttctcccttctacttctggattaatggcgaccgcatcgactccctgctggagaacgaccggcagcagacccacgccctggatgtcatgcaggacagtttcgaccgggcatccagcatcatggatgagctgttccaggacagattcttcacccgtgaggcccaggaccctttccacttctcacccttcagctcattccagcggaggccttttttcttcaatatcaagcaccgctttgcccggaacataatgcctttccctggctaccagcccttgaatttccacgacatgtttcagcccttcttcgacatgatacaccaggctcagcaggccatggatgttaacctgcacagactcccccactttccaatggaattcacagaagaagacaaccaggacggcgccgtgtgcaaggagatccgtcacaactccacagggtgcctgaagatgaaggaccagtgtgaaaagtgccgggagatcttgtctgtggactgttcgtccaacaaccccgctcaggtccagctgcgacaggaacttaataattccctccagattgcagagaagttcaccaagcttgtacgacgagctgctgcagtcctaccaggagaagatgttcaacacgtcctccctgctgaagcagctggacgagcagtttagctgggtgtcccagctggcgaatctcactcagactgaggacccgttctatctccaggtcacgacggtgagttcccagacttctgactccagtgctccctctggcgtcactaaggtggttgtgaagctctttgattccgaccccatcaccgtgatcctcccagaagacctctccaggaacaatcctaaatttatggagaccgtggcagagaaagcccttcaggaataccgccagaagagccgggaggagtgagatgggaacactgcctctccacatggcaggtgtctgagttctgtcgcccccgcgatgagcgataggcccctagagagagctctgcatgtcaccgagtgaccgggccttccttgaggccctcctgtcccctcaccccgcctgtcctccctctggactctgcattgtaacaccgtgttcactgatcatgggaagaactcctgtgtgccactaactcaataaaaccaccagtaatctgaaaaaaaaaaaaaaaaa

SEQ ID NO: 498 - DNA, 571 bp, Homo sapiens
  misc_feature (249)..(249): n equals a,t,g, or c
  misc_feature (548)..(548): n equals a,t,g, or c
tcgacccacgcgtccgggggcgtacgcgggcaagatggaggcgactacggctggtgtgggccggctagaggaagaggcgttgcggcgaaaggaacggctgaaggccctacgggagaaaaccgggcgcaaggtgagaagtgtggagtgagggtcgcagttgaggcgtccagcgttcggggtccgggtcgcgcttgaggagagcaaagggctaataaggaaagacagctgccgagggcgcgcatgccgggncgctaacgcatgcgcgagaagacgggcgccctcccacgatgtctggggctgcttggcgtgggactcctctggcgctggtgcggtcgtcgcgcacgcgcgggggtgggcaargcatggtcagcgacccgcagtccatctgactcctgcttcccgggtgttgctcgtgtaggtatctagggctgcctgtaggttcagatgcttgttgggttaggcgtgatttgttccgttcctctatggcctagctggtctttaacccccgccttcgattctgagtcagacagactccccagttcgggcangcaattcccttggaacaagggca

SEQ ID NO: 499 - DNA, 2087 bp, Homo sapiens
  misc_feature (56)..(56): n equals a,t,g, or c
tcgacccacgcgtccgtggggccgagcgccgctgggtaggcggaagtagccgcagnatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcagacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacaccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgrwwaaaaaaaaaaaaaaaaagggcggccgctctagaggatccctcga

SEQ ID NO: 500 - DNA, 1409 bp, Homo sapiens
  misc_feature (1180)..(1180): n equals a,t,g, or c
  misc_feature (1384)..(1384): n equals a,t,g, or c
  misc_feature (1392)..(1392): n equals a,t,g, or c
acaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgccatctatgcagtcactgkttncatggggctctgggccttcatcacagctggagggccctycgaagtattcagcgcagcytcttgkgaaggactgactacctggactgatcgctgacagatcacctgctgtcmctgccatgactgagccagcccagccggtccattgccaaatctctctttcgcggctacccatactcaggtttgttgcctttggacgtagcttanttacaganagctggtcagcagcagt

SEQ ID NO: 501 - DNA, 2571 bp, Homo sapiens
ccacgcgtccggtaatcttcaaatatgcgcatggcgagtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggaaaaaaaaaaaaaaa

SEQ ID NO: 502 - DNA, 3080 bp, Homo sapiens
ccctctaacctccagagctatggtctcagatgcttccttttagagagaaggtcattagtccaccaagaagccaaatgacaacaggaaaggtgatgggaagatgaaaacaaaggaaggtggacttttgggtatatgttatagccatgtatgtatgtcttcttttttctattttctcttgttcttcatcttaactgtcctcaatctgccccacaccaaccctgtgtcactcccagcacacataagacagagcagaagaccccatccttgagctggtctcccctgggtatgggctgaggtaacatcccacacaccaggacgatcttccctgcctcccatcggtcacattaagacattttcaaagtgtaatattataaatggacctacctctaaatattgactttacagttattttatgaggcactcaatttatagctaagggttttcagtctagtgtcatgaaagagataaaagggtgttcacagattatttaagacataaggctggtcagggatgagtcagagagtcattctccatgaagtcacccctggccaactttgaaaggaagaatgtttaactgcactttgggcgtaaatgacaagcatctgggaccctccccttccctgatccctgccaccaccactcaatcggccagataatcaattgtttctgaggtcactttcacataatcttggcaactttagttgttgaaagcatgcatgcaggggcaacatggtgttacctgttgctttttttttcccccttctaagctccttaccagagagcagatctaaggatactgtgtaacttgaaataaccggcattttcagactttgccatttcatagtccatagggcaagccatctttcagggatatccacatggtgggcaggaaatcttgacattggcttctcagaaaatatctgcctagtcacacctgggaattcactaaacacccaaatgcagtgtttgatgtggccttacctgctccttgtatcttattggattgaatgagaacagatgcaaaacaagtatgtacagaaatgccaggaaaactactgtcttccaatggggttcaacagttcaaagccctccattgatggagccacttaggaggtttcagtgtcttaattcttttagattttgacagttttagaaaactaaaaaaaaaaaaaacaagtttttatcgtgaaatttgattacaaaagattttgagagaaatgataagaaccagatctgaagaatttgaaatttgaaaattcagcagagcatttttttaaatgtatcttgtacaagatgaactaaataaatgtttttaaactgacttctttttggtggatttcaaaagttaaccttcagacttatttagagggttttcataaagcaagtttttttctgttgctgctcaatttctttcttttcttttctatcttttcttttctcttccttttgctgttccctgtgtgtgaagcaggaggggcagctgaaatgctttgcatactcaccctggtcattttccagttaggacaagctcaaagggagagcacagctcagaaggtggcactcatgactcaggaaataatttgtggctcatttgaaagcagcatcttctaagtgtgttgcaaaatagagaaaaatcaacaggttgttggggtgtttattttccccactgcgtatgaaagctggtgctgctgccctttgatggccaagaggagctcctggcagccgtggccatgtgtcccggggtgtgtggggcaggcggcagttcttggcagccttctctgcagggctgcttcctgaccttgcttcaaagccttctgggctgtagaccacacagagctcaccctcaagcagccacgctggaccacattgctttcactgattttgactcatctcccccatagtgcagtgtgtccaaaggtggctgtgggtgacacagccgtgtgttcgtgctgtacggcactgtggtcatgggggtgacgctggagctcctgattagtttgagttcaaatcccagcctcgctggtgggcatgcttagaacagaccctagcaggcgccaagccccagtaagtggtggagtcattggtaaaggataatgctgaatgcaggacatttatatggatgaaagagtatgggaaagggaatttcagtgatatgaattccaaagcgtgttagtatattttataagaaacaaaaaggtattcaccagcaccaccaaactccatcatcagtcacaggcaaccaagaattgatcactctcccagaactttgggaggccgaggcaggcagatcacgaggtcaggagatcgagaccatcctggctaacacggtgaaaccccgtctgtactaaaaatacaaaaaaaaaaaaagaaaaattagccgggcatggtggcgggaggctgaggcaggagaatggcgtgaacccgggaggcggagcttgcagtgagccgagatcacgccactggactcctgcctgagtgacagagggagacgccgtctcaaaaaaaaaaaaaaaaaaaaaagaattgagcactcaagtccgtcttctaaactgcctgaacctcttgagatgagaagaacaaaacaaacctgcgctgtcctgatgtaggttaccctaatggagcttcctgggttctcctctccctgtcacatctcagggactccaccttattttaaagctgtcttactagcactgttggacttttctgtttcagatgctcaaacaagagatggagcaggggcagggtttggggttaaatgggctggaggtgagattggcccccctaaggtgttgaggacacttggggtgaaagtcgttagggtatatgtaggtcagagccagggccgctgcgtgcacagaggtctgtcatggagcggccagtaggcaccaaaatccagccaaagctcggccatgagagctgggtagcggcaggggtgacaacagtggccaccctggtaaggttaaggtcagacttgggttagtctaagctgtcagagggtgttcatcatttttcttacctttccaatagtgaccctattccaaaggccttgtttcttgtgccagagaagaaactaaagtata

SEQ ID NO: 503 - DNA, 1837 bp, Homo sapiens
  misc_feature (48)..(48): n equals a,t,g, or c
  misc_feature (987)..(987): n equals a,t,g, or c
  misc_feature (1037)..(1037): n equals a,t,g, or c
  misc_feature (1312)..(1312): n equals a,t,g, or c
cagcagagcccagcgcggtgctatcggacagagcctggcgagcgcaanggacgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagagaaaagcttcattctggaggggaaggagttttgagtgccaaggatgaaattccacccatcactcggtctctgagctgcaggacacaggcaggacaacgggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggararctgcatgctggggagtgccctctgccctttccagggcaatttcaccatcattttgtatggaagggctgatgaaggtattcagccggatccttactatggtctgaagtacattggggttggtaaaggaggcgctcttgarttgcatggamagaaaaaactctcctggacatttctgaacaagamccttcacccaggtggcatggcagaaggaggctatttttttgaaaggagctggggccaccgtggagttattgttcatgtcatcgaccccaaatcaggcacagtcatccattctgaccggtttgacacctatagatccaanaaagagagtgaacgtctggtccagtatttgaacgcggtgcccgatggcangatcctttctgttgcagtgawtgatsaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatattycaatgtttctttgtccagtgartgggttcaanacgtggaktggacggaktggttcgatcatgataaagtwtctcagactaaaggtggggagaaaatttcagacctctggaaagctcacccaggaaaaatatgcaatcgtcccattgatatacaggccactacaatggatggagttaacctcagcaccgaggttgtctacaaaaaagsccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcgggggtcgacgcggccgcgaatcccgggtcgacgagctcactagtcggcggccgc

SEQ ID NO: 504 - DNA, 1188 bp, Homo sapiens
  misc_feature (892)..(892): n equals a,t,g, or c
gacggagcgggcgccttccgagcgccgatcagggagcccggagtccccgcgtccccgcagcccccagaacccggacaactgttgcggcggcggcaggggcatcgcgggggcgtgggcagcccccgcaccccagcaggcggctcccgcgggcgccggctcccggctacgaagcgaggaacgagcgggcggcgggcacgaggcagctctggacggatcaatgcaagccagacgatgaccagttgtggccagcagtccttgaacgtgctcgccgtcctcttctcattgctgttttctgcagtcttgtctgcacatttccgggtctgtgaaccatacacagaccacaaaggccgctaccactttggcttccactgcccccggctctcggacaacaagaccttcatcctctgttgtcaccataacaacacggtcttcaaatactgctgcaacgagacggagttccaggcggtgatgcaggcgaacctcacggccagytccgagggttacatgcacaacaattacaccgccctgttgggagtgtggatctatggatttttcgtgttgatgctgctggttctggacctwwwgtatwamtcggcaatgaactacgacatctgcaaggtctacctggcacggtggggcatccaaggacgatggatgaaacaggacccccggcggtgggggaaccccgctcgggcccctcggccgggtcagcgggccccacagccgcagcctcccccaggcccgctgccacaagccccacaggccgtgcacacattgcggggagatgctcacagcccaccgctgatgacyttccagagttcgtctgcctgaaaacgcttttgctgtgcctcaggatgggggagatgagatctgaagcacccggtgcagcctncgagaagaacaacttctacagagatgccagggacagccgaggtagcggcgrtggcacaggaggaaatgctgcctgtgcccaaagcccccttccacggacttctaagattaggagcaaactcaggggtaggggctgggggtgcaggggaggggattctgagccacctgtccgcaagcaatagtcctattttgggctggtggcttctgagaggtgactcattgtggactcaggatgaccaagacaaaggtcgacgcggccgcgaattcccgggtcgacgagctcactagtcggcggcc

SEQ ID NO: 505 - DNA, 3369 bp, Homo sapiens
ggattcgcggccgcgtcggaccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagmcccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactycctattttgtaaacmtatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgayagtgactatgtcagtctaatctcttgtttgccarggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacckcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaayggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacaaaaaaaaaaaaaaaaagggcggccgctgcgcgatc

SEQ ID NO: 506 - DNA, 558 bp, Homo sapiens
  misc_feature (27)..(27): n equals a,t,g, or c
  misc_feature (39)..(39): n equals a,t,g, or c
cgggaccggataacaaatttcaccccnggaaacaggctntgccccactaggcttttggcaaaaaagctattttaggttgccactttaggaggtacgcctggcaggtaccgggtccggaaattcgcggccgcgtccgactcatgactgtgttggcactttaaaaatattgatatcccacaataaacagggttatcattgatataatttcccacatattttactataaataatcgagtaacaacctgtcttgtaccattctttacagaaaggcttttctcaatgcgttagtcagggtttcttcccggggagaaaatttataatccttaatgaggccagtactcagaaggacatttctgcttactcttttctctgtaattgccctcactaaaataaagcatgacttttttatcatgtgttcacacatgcagtgcatccctagagtttttctgaagcatgaattcaataacatataattagacctgattctgagaagattttctcttcttcgtcgacgcggccgcgaatcccgggtcgacgagctcactagtcggcggccgc

SEQ ID NO: 507 - DNA, 2499 bp, Homo sapiens
caccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcagactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtgtactctcactttaaactcaccaaagaagattctcttaaagaaattatgaaaaatgtacaatttaacattttaaataaatagtgacagaagttgtttaaaaa

SEQ ID NO: 508 - DNA, 3530 bp, Homo sapiens
  misc_feature (30)..(30): n equals a,t,g, or c
  misc_feature (59)..(59): n equals a,t,g, or c
  misc_feature (79)..(79): n equals a,t,g, or c
  misc_feature (3465)..(3465): n equals a,t,g, or c
  misc_feature (3471)..(3471): n equals a,t,g, or c
  misc_feature (3485)..(3485): n equals a,t,g, or c
  misc_feature (3487)..(3487): n equals a,t,g, or c
  misc_feature (3505)..(3505): n equals a,t,g, or c
gacatgaagccaaccggcacccggccccanatttgttataacagtactctaatttgaanccatgataaaaataaccatncatttgtaaatccacagaggaccctggtgaattcctaacacatattttctgtcttgttaagctgttgaattgcatcatggtggagaaatgtgtaaatagaagtaatgatcttggtgtttgtaaaaggggtatttgaaaggttcccgaaagtgtgagggggctgatagcagatctgcagcttctccccccgtgcactaaagccaatcataattctttctacctggtttgtgtcatcctccattaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttgagtcccgtttgttaaggattcttctattnccttgncagatttgtgttcngnaccccacccccccacctngtggtattcggttcagaaagggcca

SEQ ID NO: 509 - DNA, 1145 bp, Homo sapiens
  misc_feature (386)..(386): n equals a,t,g, or c
aattcggcacgaggacatattggccatttactctactaataaaagagtactatctactcagtgtcatttactgttactgtagtaattaatgcctttggaagaatcttttgaaatagttctcaaattggtaccactacttggtttggaattatttttttttcttttcataatcaatggttatataaatgtatattgtcctagtcagtattttatatatgctaaggactcactagctggcttggcactaatacctcaataaaaggaatacttcttttggaatcatgaaacaaaagtgartaaacctccaagttatttttccaaccaaccttctttgaaaaatcttggatgagtcactcaaatcaagacatgttataaaattatctgtnattttggtagaacatatacattgtyctaataataatttycaaatattcagtgkaacygtaagkatgagaatacaggttgaatatcycttatccaaaatgcttgggaccagaagtcttttggattycaaatttttaaatatttacatcatacttaccagtttaacatccctaattcaaaaattcaaaattcagaatgctccaataatcgtttcctttgascatcatgtcagtgctcaaaaagttgcagattttgaggtatttcagatttttgaattaggaagactcaacttgtactatcattctatagactttatgattgggtagactacatgagtattgaacccagaaatcattgtctagcaaaagccagtatagtgattaattaccctgtgactattatataatgttcaaaaaagctaacatattagaatgtccttagcgtgcagagagcaaacagagacaaaaagaaaagttaccctgaaaagtttgtcagaaaaatagaatatcagacgctraactactcatccagaattttgtcraaaaagaaaaataagataaaattcactggtagacaaaaagtagtaacataccagtttgtaatttctcagtttcaaaccatgaatatgtatttgtataccaaaaatcatttcaggagtcagagaaggaggatatgccttttatgtggagactttaaacataaaattggaaaaaaaaaaaaaaaaaaactcgtagggggggtcccgtacccaatcgtcctgt

SEQ ID NO: 510 - DNA, 2214 bp, Homo sapiens
gcagtcgcagcatgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttggggaagaaaagaggttgttgctactcttctcccatcagcaaaagaacaacaaaaggaagaagaggaaaaaagattaaaggracatttaackgaaaktttattttttgagcagtcgtttcaaccaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctayacctgttgtgtaagaaactttaaaacattkgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgaaaaaaaaaaaaaaaaaaaaaaaaaaaaaaaaaaaaaactcgagggggggtcccgtacccaat

SEQ ID NO: 511 - DNA, 590 bp, Homo sapiens
attggatcgttttcctactgggacgtggccccagcttctccgtgactctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacrcatacagctttgttgaaaatgtggacttttagtgagaagaaacaaatgttaatacatttagccaagaaatccacaagtaaagtactcttatgaaaacttgtaaaaaaaaaraaararrraaaaaaaaamctcgagggggggcc

SEQ ID NO: 512 - DNA, 1943 bp, Homo sapiens
  misc_feature (161)..(161): n equals a,t,g, or c
  misc_feature (1926)..(1926): n equals a,t,g, or c
  misc_feature (1928)..(1928): n equals a,t,g, or c
  misc_feature (1934)..(1934): n equals a,t,g, or c
ggcacgaggcttggctaaggtccgcgggaacccgtgagccaccgagagagcagagaactcggcgccgccaaacagcccagctcgcgcttcaggtcccggcgccgtcgcgcactcctccgatggccacagatgtctttaattccaaaaacctggccgttcangcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtcactgtaaaaaaaaaaaaaaaacncnggggtncttttgggg

SEQ ID NO: 513 - DNA, 2527 bp, Homo sapiens
ctcttgctaccttcccggcgcagagaaccccggctgctcagcgcgctccggggtcatggagatccccgggagcctgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaaaaaa

SEQ ID NO: 514 - DNA, 4712 bp, Homo sapiens
catggtacgcctgcaggtaccggtccggaattcccgggtcgacccacgcgtccgcccaygcgtccggcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcmtgcgcctgcctctcagtgtmtccaactttgcgctggaagaaaaacttcccgcgcgccggcagaactgcagcgcctcctcttagtgactccgggagcttcggctgtagcckgctmtgcgcgcccttccaacgaataatagaaattgttaattttaacaatccagagcaggccaacgaggctktgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcsccgcggcgctactgsccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctckccaccgccgccccaggggagaagccgccggcaccactacagttccacctcctgcggcggaatcggcagggcgacgtaggcggcacgtgcggggtcgtggacgacgagccccggccgactgggaaagcggagaccgaagacgaggacgaagggactgagggcgaggacgaagggcctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtwcaaacaccccagsattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccctgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgmacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaaaaaaaaaaa

SEQ ID NO: 515 - DNA, 1051 bp, Homo sapiens
ggtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaaaatctagctgcccacagtgaacagttctgcactgctcctctattccctgagctttacagagtccagatccctgtactgctgaactcaggcagaaagaagagtgcagtttattggactccaatctcattcaacagaacaaagaagttgaggttgcaaggaagaacctataatgatgggtcatggaatataacctagaaaagaagagaaataaaagagactgtgtttcaccatgttgcccaggctggtctcgaacttctgagctcaagcaatccaccctcctcagcctccagaagtgctgggattacaggcatgagacaccaagtccagccataaggttcttattctatatatacatgaaatgatatcacttgaaggtagactgtgataagttaaatacgtatattttttaaatcttcaaacaaccactaaaataaaagaacaaagagttacaactaaaaaaaaaaaaaaaaaaactacgtagggggggacggcgtacccaattacgccc

SEQ ID NO: 516 - DNA, 1895 bp, Homo sapiens
ttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatctccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgccccaccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtct

SEQ ID NO: 517 - DNA, 707 bp, Homo sapiens
  misc_feature (562)..(562): n equals a,t,g, or c
  misc_feature (570)..(570): n equals a,t,g, or c
gggtcgacccacgcgtccgcccacgcgtccggtttctacaacccttaggaacatcagaatcatgtgtgtgtgggtgcttattaaataaamsagttcctggagctcactcccagtgactgccagtctgatgattaggggctcagctaggacctaggtttgcgaaagctcccagctgatctcatgcagccagcctggctctggctctggckctgggagctgggttgggaactagtctttggtgctattctgctgawacttcaagatgggctctttgactccgtcttgtattgtcakcacttgtattcaggtctgttcttcccctggattgtaaactccttgatgtctgggtcatctcagctcatgagctgagcttwcagtgggtgctcagtggaacagatgctgaatggagtcaggctgtagggaggccagcgtgtgttggtaagtgagagacaaaaatcattttaaaaagaatctttttgcccttcagttgtgtttgccatgagttaatgtgatttactctagtggaagccagtgcagcttaagtggaggtcttgccctgaantggagccnggttatggatcagcagagctgccaaaagcgttttgggggaaatgtttctgtgtcaccctcagttgattgaactcaagttttcactcccgtttaacaccacgtgggggccattctgacttctgcggagtgggtatgat

SEQ ID NO: 518 - DNA, 1945 bp, Homo sapiens
gagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtc

SEQ ID NO: 519 - DNA, 599 bp, Homo sapiens
gaattcggcacgagcgtccacgcagccgccggccggccagcacccagggccctgcatgccaggtcgttggaggtggcagcgagacatgcacccggcccggaagctcctcagcctcctcttcctcatcctgatgggcactgaactcactcaagactccgctgcccccgactccctgctgagaagttcaaagggcagcacgagggggtctttggctgctattgtcatctggagggggaagagtgagagccggatagccaagaccccaggcattttcagaggtggcgggaccttagtcctacccccaacacacacccctgagtggctcatcctccctttgggcataacgctgcccttgggggctccagaaacaggcggtggggattgtgccgctgagacctggaagggcagccagcgtgccggccagctgtgtgcattgctggcttaatatgcagggcttggggggctgtggccacatgcccggcaggaggtgagtgaggagccctgtggcgtgctggtgtggggatcgtgggcatttcaaacgggcttgtcgtaccctgaacaatgtatcaatagagaaaaaaaaaaaaaaaaaaactcga

SEQ ID NO: 520 - DNA, 978 bp, Homo sapiens
ggcacgagcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataataaaaaaaaaaaaaaaaaaaa

SEQ ID NO: 521 - DNA, 528 bp, Homo sapiens
ccacgcgtccgcacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaaaaaaaaaaaaaaaaaaaaaaaaagg

SEQ ID NO: 522 - DNA, 813 bp, Homo sapiens
  misc_feature (283)..(283): n equals a,t,g, or c
  misc_feature (691)..(691): n equals a,t,g, or c
gcaggaatttctacctatatttccttccttactgtgttgtgtgtgtttgtatgtgtgtgtgtttaatttgtagcatttgccagtttctgtggtgtaaatactcccactacagctgttttcaagctaacattgtgataccacaaaaaatggaattgggaaggcacaatcaagattaacaagccagtttagaccaagacaatttttctgccctattagttgggcacaagttagaaaggctgatagtatctcatgttggaaaggtgagagagaaggccctcatgcnttattaatggcatatgcattgaagtgccctgtttgagggcatgctgttagtaacttttaaaatatgagatgtcatactttttgactgaaaatacaactcttgtaggattctattttatagaactacttaggtgcataaatatacaaaaataactgtcattgcagcattatttgtaatagtggaaacagaagacttttcattaataagagaatggttaggccagatccagtggctcacacctgtaatcccaacattttgggaatccaaggcaggaggatcgctttagcctaggagttggagaccagcatgggcaacataacaagaccttgtctctactaaaaaaaaataataataattagtctggcatggtggcacacctgtactcccagctacttgggaggctggggncaaggaggattgcttgagcccaggagattgaggctgcagtgaactgtgatcacaccactgcacaccagcctgggtgacacagcaaaactctgtctcaaaaaaaaaaaaaaaaaaaactcgta

SEQ ID NO: 523 - DNA, 665 bp, Homo sapiens
ggcacgagaaactccagttaatgccatttattttgcttcttgtttgcttaacctccctgccttctaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttcttttctccatgagaaagctaaacatgaaatataatgaatatagtaattattaagggattgagacaaaaactgtgattttaatacttaaattgctaaagaataaataaatctgacaaaatgggtggatatcttttaagtttattacagaaaaaaatgcagatgatctcttaaaataaaactaaagataaagcaaaaaaaaaaaaaaaaaaaactcgtagggggggcyccggtacccaatcgccctatgagtgagtcgtattac

SEQ ID NO: 524 - DNA, 723 bp, Homo sapiens
  misc_feature (722)..(722): n equals a,t,g, or c
tattgtagttagaaccatctgacacatagcttttattccattggttttttgttatgtctttctttacaagaatttgaagtccatcaggccgggagttttgtttgttgtgtttgctgctatctcccagtgcctaaaattgcctggcatacagtaggcatttaataatctttgaatcagtgaaaaccagatggtggcttggcatttccacataggaatgagccaggtggaaatcatccaggatataagtagatcttgaagtgataaggaagggtcatcataatcatgtggggcccattttgccctttcttgtttcttttctctaggctcagcaacagcctcaccaaggactccatgaatatcaaagcccatatccacatgttgctagaggtgagagcagctcaccccactaccagactctgtgtttagggtggtgacctgaagaaggaagagagcgaaagaagggaaggaccatctttccctctaaactggagtcaagggagggaggtcagagcaagcctgggggcgtaacccagacccagtctttgttcaatctcttctgtcctctttttcaggggcttagagaactacaaggcctgcagaatttcccagagaagcctcaccattgacttcttccccccatcctcagacattaaagagcctgaatgcctttgaaaaaaaaaaaaaaaaaaaaaaaaaaaaaaaaaaaaaaaaaaaaaaaaaang

SEQ ID NO: 525 - DNA, 2466 bp, Homo sapiens
ggcacgagcaggggcttagatgctgctgcgccatcccttacctgtctgtttctgtttctccttctgtcccttcccagtctcagcactgagtctcttgcccattggcctggtgagggaaggagctgccagccccacccaacagctcaggttacagagagagtcactttcttccattactcacagagtaaacatcaaggaaggccactgattgattgacagtgtctgggtcagatgtctatccttaggccagtccctgtgaacaaggggatgggtgtctgcgtggaccagatctgaagcacaggcccatgcctggggccaggggtgggaactatggacctctctccccactgagaaccccagggagcaggtgaggtgaaattcctctaggggaagaggggcaaaattgacaagatagcagatgtctaccatactgctgtggggcctggtccctcccagaaggaaaaacatagtaacaatagagtgggtctcaccctccacctgggtctcaagtagggtgtggatgaggacaatggaaatgaaggaaaggttagaaggcctgtggtaccggttggtaaatagctcttcgtgctttctccatatggagtgagagtgcttggatgtgattccttcaaagtcaggtctaggagactcaggatgcctaatctagaggtaagaacattgtgaggaaagccagtgaattcagtcttgtgcatgctgactttgaagtacttttggaagagccaagtggaattatccacaggacaggaccaaatcttacctggttcttccccaggccgactagtccacaacaggaaataaaaagagttgccccgataccaagttgtactagtccattctcacactgctatggggaaatacctgagactgggtaatttataaagggaaaaggtttaattgactcacagttctagatggctggggaggcttcaggaaacttacaatcatggcagaaggcaccacttcacagggtggcgggagagagaatgagtgcccagcgaagggagaagctccttataaaaccatctgttctccttataaagatctcttaataaaaccgtcagagaactatctcattcactatcaggagaagagcatgggggaaccgcccccatgattcagtttactccacctggtcccgcccttgacatgtgggtgttattacaatttaaggtgagatttgggtggggacacagagccaaaccatatcacaaggctttctcctccttgctgggattgtacccatagcctctttctgagtcctctctcttttagcctctttatgcctgcagtgcatccttataccatttctagagtcatctttataaaacttatactctccgtatgactcataaatcctgtttttttttttgcacagtatattaagtataaatttgttaaagtctttaatggtctgcccccaagctacatttccattttgtatgtctttcagttcctttctactttgtatttggctgttgagttaactgaatttttgccattccattaacccatcccatgcttttcccacttctagatttcacttttcttgtaggctagaatgtcttgactgggatctgactggagataatgagaacaaaaactggttcaaagagccaggatgttgcataaaagtcctaagattgtatctaagcaggtaaaataaaaattttaggcaattacttaaatttgaaatgctcacatttattaataaggcatgtaacatctacatgagccatcatttgcttttttaattccacattgattaggagccaaaccttcagggcaggtatccggtagagcgccctggagaggccctggataggcacaggcgcctgtcagggggctcttcacatgctgtgtgctgctgctgggagaagagggggccagagactagggggcttctaagaagaggtggcatttctgcctcagtgttgaaggatgaataactttgacaggctggaaaaaggtgacatttcaggtagagcgtgtcacatggatgtaaataccaaaggtcaaggacatgggcttgagagatggtgagaaggatggaggtgactgtggcttgcattctatccgtatcactattaattaccttctaatgcctttggctctaggtggtggaacaagtaaagtaatggacaaatactttttctaccaatatttagtgaccaaatgcagagttatggagagggccagggacctcatgaaccatactctttctagtctagggacataactccaatgcctttcctgtcccagtaagaggccatggatttcaagaagccagacaatccattctttcagataatgataaaaaagaaaccatttattttatttctaagtatagaatgaaacatttatagttgcccaaattttggtaccttttaggagaaaaatacagatttttttgttgttaaaaataaacttaaaaaaaaaaaaaaaaaa

SEQ ID NO: 526 - DNA, 1739 bp, Homo sapiens
ggcacgagagatcctcaggatatctttagccaaaggaaaagctccgcattcccacctggggggaaagctggattgccatgggcacgaagtagtggtgcagagtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccaccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaaaaaaaaaaaaaaaaaaa

SEQ ID NO: 527 - DNA, 1139 bp, Homo sapiens
ggcacgaggtcactcctaatgtaggatgggacgattgccccaagctctgtcgtgagtggttgattgacggttttcttaagggaacaatgctgggaaagatgataggcgcccgccactgacccctcccgcctccctgcccctccagtaaactcccacacaaaatagcagtatgaggtgtggggaaataatcttggcctccgtcctgggtttacttttgactctgccacctacaagctgtcacctgaacaagtcctttccgttcctgtgtcttccctggtcacaagctctaagcctgaacccacactctgggaatgaagcagggtagcggcctctgcttcagcaactctgaggggtctaccttgggtggggagttggcctcatccagagggctgctggagggccaagacaaggctctggtggggaggtgtgctgagaggggattgcttatcccaccaccagcttttctgggggaggtggggaagtgatggttaaaaaatggagttcctgctatcagccatgtcctgatgaattggaaagtccccttctttctcctttcctcttgcatctcctgcctgcttcccctgcctgccctcctgtgacatgtgccctctccagcaggtatgtcacacagcaccccaagggaagggcagtgtaacgctcttttccatgatggactaccacagccagaggaagacaggccttcccttcttttctagttctttttggtttgaaaacaaggcactcttattttccccttccaagaagctggtggttcacacgggccagcacacacattatcaaagacctagtttgtttctagtaaatgagtccattgaagtgggagccttggccgggcaaggtggctcacacctgtaatcccagcactttgggaggccgagatgggtggattgagatcgagaccatcctggtcaacatggtgaaaccctgtctctactaaaaatacaaaaattagctgggcgtggtgacacacacctgtagtcccagctactcaggaggctgaggcaggagaatcgcttgaacctgggaggcggaggtaacagtgagccgagattgcgccactgcactccagcctgggcgacagagtgagactgtctctccaaaaaaaaaaaaaaaaaaaa

SEQ ID NO: 528 - DNA, 1677 bp, Homo sapiens
  misc_feature (1012)..(1012): n equals a,t,g, or c
ggtgcagtggtgccatcacagttcactgcagccttgacctcccgggctcaagcaatcctcccacctcagccacttgagtagctgagacctcagatatgtgccatcacacccagctgattttttaaaattaattttttgtagagatagggtctcatatgttgcccatgctggtctcaaactactgggttcaaatgatcctcctgcctcagccttccaaagtactgggattacaggcatgagccaccatgccgggctgggaggcggaattttgttcagtctaaagataagctttttcatagctctggctgtagtgggagggagcagaggagtgaatgattgtcagttgggagggtgcagagtgggctcctgccctagggtgraggtragggtggcttaggtgasmcamcacagaggccctgttcagccccacgtcccctccctgtgctccctcctcctctctcctctcctgcaggcgtggraggtatcatcattcagcagatttcaccagaggcagtggaggaggcaggtacctgagccagaattcagaatgtcttattctccacttgactctgccactaacttgttgtgcaactttgggcctttccccaggccttcattttcttttcttttctttttctttytttttttttgaggcggagtctcgctatgttgcccaggctggagtgcagtggcgcagcatcatctcggctcactgcaagctccaccttctgagttcacgccattctactgcctcagcctcccgagtagccgggactgcaggcrcccaccaccacgcccggcttattttttgtatttttagtagagacagggtttcaccacgttagccaagatggtctcgatctcctgacctcgtgatccacccgcctgggcttcccaaagtgctgggattacaggcgtgagccactgcgcccggccattttcttaaatatctaataaaaaatatatagcaaatgcagtttttaaactacgacaatatgaccacgcaaaagantattatcttccaagactgctggtccaaggaaaagtcagtaataaagtggaagcattgtagcttatggaatgactggttasatttgggagaagccttagcaataatctagaatctgcatagataatacatctgaggattgggctttgtggtttacaaagcatttttttttcctcttttgatcccagccgtttgtctggactgatacaaagcatttttattagtttgtcttattcaatcctcacaccacctcaaatttacagaggatatggatctggttaatttgtatgactatgtaacctcatgtcagtccacagcactgcctggaggtgggtagaggtggtcctgggctggaatcccagccccagtgggaccttgagcaagttactttagctgtctgcacctaaatttcctcactggcaaaacaggaatactggtggttcacacctgcaattccagcactttgggaggctgaggtgggaggattgcttgagtccagaagttcaaaaccagactgggcaacatagcaagaccatctctacaaaaattaaataaataaaacatttacaagggttgtggtgaagattaaatgagatcactcacgaaaaagctcagcagaccctgatgtgcagtaggtgctcaataaatgttagccagcaaaaaaaaag

SEQ ID NO: 529 - DNA, 2648 bp, Homo sapiens
ggcacgagcttgtaggtactcattgaggtttattgtgtaagatgaatgaatgttgcaaattcctaaacatgtgattcagatgcccaatcttactctgttactttatgaaaattttttaaagctatatgatgttatatcaaaatatgttgttatactttaggataatcggtgtgttagccctgaatttcagcataagtcccatttttttccatgggagtctaggaaagctatatgtttattcagcagcaaaatacagtttggaacttaaataaactattgatcaatttctggtcttatgctagaaggaataaagcatcaagaaaaagaaaagatttgctgtcaagaccaggaaaatttgacaatagagtattagaatgcaggaaatgaggggaagtggaaaggcagcaagtaggagagaaaaagtgcagggacagtagaaagtgaatgtaggagctttctgacccatgcacttcaggaacgcaattcatccctaaaatgctgtttgctgtcttaggttgcaagtaaccaaattaaaaccagtttgaaagtagagtgagacagctgtcatcataagagtcatttgatctgtttaaaggtggctgcttgtatgcagggaccaacagtcatgtccagggcagcagctggtgcacacttcaagcacagaccataagagctaccccaggcagcacctgctaccaatagtgcaaacaactcagagagacctcgttggcataagggaatactctctcctttctgagtaaagagcaagtagaactaaaggtttcacattttaaacatactttacattcctcctcttctggggctcaagcctacttttgggccaaagcggatgttatatctgacatagagtcctcggagcagcagttgttcctgaaagttcctttttgcatctttgtgcctcatgcagtggcttacaggtcaaccagacttctcccctgacttttgatgtgtaagagcttgtgtttcaaatgggtttggttttcttaatgtcaccctaggttggtggaaaggagagtaaatggaaatggggggagcagggtcccctggggaggtttaaacagatggaagtcaattgtctcttgagaatagaggaggctattgagttttcattccacactctgctcctgttctgtcagcaaagaacaaggactactctccagcaattgctttccactggactcccccaccccggctcccacaaaaacctagggatcaacttagttcactccaaattagaaaatttaatagtcatttgtttcttcttgtccacagggagaaccattttctttccttctttcaaaattgcccaggtcttgtgaagggttattaacaccagaaagaaatacattttaataagcttaaatctcatttctacatgaaaccatcagattttagtactgcaatattttgatccctctgtcttttaggctctgacaccaaaattgccataatgaaggtgtttcacttcttctcatttatttttatgggatcttttattcccaaatgccttttcatcccagccaaagggagaaatgttgatagatctgccatcaagaaggttccaaagctggcctgtcaggttttctgtttccttgtttattatctttgaacttttgttttaaatgttttaaacacttatttaccatgtaactaaatgcctgatagcattgaaagtactttatgggttttaatttatttaatgctcatgaaaccctatgaggtaggtactgatattatttttattttactgatgaggaaagtgaagcaaagagaagtgaaatgaaaggtagtgagtgatgggaccagggtttggacatgggcagtctggctctaaaatgtatgcttttaactactatgtaatgctgcctcaccaacaacttgtctcacaaattgatattctggatcagaggatgtcgactggcctgcaaatgtattttgtatggctcatacacagttcagaagttttaaaaatttacatagaaatctgcatttcctgacttcttttgaaaatgggaataccaaacatcattaggcttgaattcccaatacggcaacaacagctgagcaacaagcagctgtttagactaggcaccttccgttcattccagcccacaatgcagatcatagtatcgacttaaatttcctgcctgccttagagaagcttctgagcttgtgacctctattctagctgctctatgaatggacgctgccccagtacagcgaggacctgctgcaaaatgcatttcttagtcttcaatacttattcctccttgtaactggatttctggtaagttatgtctcatggtggatctgccccaaagatggagactgaatggcagtgagtcactcgccctggcctccattgttctggagaaggttccagccacatggttgatgtcagctggttttccagagccagagctgggttgcaggacagacacacctgcatctaatagtgaaaggcaaagttgaaaggccaagaccagcctgaggtctgagggaccaagggcttcacagaggccagaagttcagaggtggacataaaaggtgttaggagaataaggaagtgaaaagaacatagtacagtgtatcagaggaggagctccaggctggcaaatatcactccc

SEQ ID NO: 530 - DNA, 3107 bp, Homo sapiens
ggcacgagagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaaaaaaaagaaaa

SEQ ID NO: 531 - DNA, 1466 bp, Homo sapiens
ggcacgagctctacctgaatgttcccctagagtttcatacacaatgtgttggaaacctaaatgtatccttctcctcagttttgtatttcagtgtgtggcatcatcaacatttgaccccctaggtagtgagagaccttggagtcaacctcaatgtcccatctccttccctctccttatcacagggtgttgttggttctctatgtcccgggtctcttaaaaccacctcttctcctccgcctctacagacaccaacataaatcaagtttccatcttcgtttgcctggacaagtggcaaggcagcactgaaaggatactccttcctctagtcttctctgccttttgcctactgagcccactcttctgagctgctgataaaggaatttacataccacacatcctttgatgggattgccatgctacaaagcagaacctaaatcccatgcctggacgttaggcagtctacattctggcttctgtgacttttggcctaatttttgcatcagccccaaatttctgttgtgccaccatcccagtggattctagaatttagtcttacacaatcattccatattcctttaatgagtcctttagcatttgttcattcctttcatgtgccctatccccgtacctggaattacttttcctcttttacttactcaagtcctgcaaaagccagttccattatgctggtctcactgacctctttctacatatttctggtaagaatgaattactttctcctgaaatacctctgccatattgtttaaaaattgccatatggtgctggacatgagtatgtgttcacatgtttattatctactctagtctcaatttctaaggtcttgaatataggaaccaatttattcatcaccttattccagacatgatggaactcagctttattgagaatcaagtgattatagtagatagtgaccatcctgagtatgttcatgtgttacataacaatgttttggtcaaccaaggactgcatataggaaggtgggctcataagattaatatggagctgaaaaattcctaatgcttagccatatcgtagccatgatattgtagcacaatgctttactcacgcggtgatgctagtgtaaatgctgccttaccagtcatataaatgtatagcacaaggggccaggtggggtggcttacacctgtaatctcagcactttgggaagctgaggggggaagattgcttgagcacaggaatacaagtctagcctggttaatgtagggagggcacgtttctacaaaaactaaataaaattagcctggcatggtggcatgcacctgtagtcccagctactctggaggctgagacggaaggattgtttgagtccctggaggttgagctgcagtgagccatgatcatgccactgcactccagtctgggcgacagagcaatcccctttttcaaaaaaaaaaaaaaaaaaaacaaaaaaaaaaaaaaaaaa

SEQ ID NO: 532 - DNA, 566 bp, Homo sapiens
  misc_feature (1)..(1): n equals a,t,g, or c
ntcttgtgccaggcactgggatatggtgccgaattggatacaagggagatgggacgtcctcctgtgtgtcttgactgtcggtgtgttgccgagcattggtagcagagggggctggtttggcacccaggtaccctgcctcatccccggggccttggccagtctacacagaggaactgccctccagctgagttacccattttccatggcagggaggacagcagaaaggccgtgttccatgactaatcatagcttccatctattgagcatttactgggagctgggcactgtgctaagtgtgaaacgtgtgttgactcatttactacaacaacctggcaaggcaggttcttccgttagcccctgctcaaagctaggggacctggagcacaggcggtcaagtgcttggctcaaggcacacagctcagaagtgcagatcctctgcccctcctggcatcccagtctgggggggtcaggggtgggatctctgcagtcagtgcctgggggctggatgacaagctgcagcctccccgcaaccccacgatttccatagcgcagtggagccagaaaga

SEQ ID NO: 533 - DNA, 1274 bp, Homo sapiens
  misc_feature (722)..(722): n equals a,t,g, or c
agctgagtgtgcgagcgccaggggttccagctgcacgtcccaggctctccagcgcgcggcaggccggggcgggacgaggagagctgcggggacaacgcctgtggctgggtccggagtgcgggtgcggcgcgggacaagcgggcagcatgctcagggcggtcgggagcctactgcgccttggccgcgggctaacagtccgctgcggccccggggcgcctctcgaggccacgcgacggcccgcaccggctcttccgccccggggtctcccctgctactccagcggcggggcccccagcaattctgggccccaaggtcacggggagattcaccgagtccccacgcagcgcaggccttcgcagttcgacaagaaaatcctgctgtggacagggcgtttcaaatcgatggaggagatcccgcctcggatcccgccagaaatgatagacaccgcaagaaacaaagctcgagtgaaagcttgttacataatgattggactcacaattatcgcctgctttgctgtgatagtgtcagccaaaagggctgtagaacgacatgaatccttaacaagttggaacttggcaaagaaagctaagtgscgtgaagaagctgcattggctgcacaggctaaagctaatgatattctaagtgacaaagtgttcacctgaataccatccctgtcatcagcaacagtagaagatgggaaaaatagaatatttaccaaaatntctgccatggttttattttggtaacaagaagcacaatgtcttttttatttttattttttagtaaacttttactgaagtataccatgcattcaaaaagtggacaaaactgtatacagtctgatagatatttatgtcgtgaacacctgtgtaaccactgccaaagtgaagatgtagaatattggcaacacttcacagcctcattcctgccttttctcagccattacctcccaaacatagcagtttttctgagtttcatcacctttgattcattttgcctgtttttgaactttatataaatggatttatacattatgcacttgtgtgtgtggattatttacctgacagttataaggttaatccacaaattgtgtgtaccattagttcatccattgtcattgctgtattctgttgtataaacataccacaatttattttgatatttggcacagtttctggccactacatataatgctaaaatgagcacattgtatatgtcattaaaatgaggttgaactaaaaaaaaaaaaaaaaaaaaaaaaaaaaaaactcgag

SEQ ID NO: 534 - DNA, 1084 bp, Homo sapiens
ggcacgagccaccatgcccggcctagattaaaaatttgaagacatattctctactatgagccaatgaaattactcattttgtttctatcccatttgctgtcccttgcttttggaattttgtgtcttagtgtgactgtgattctttctctccttttgtctttcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcgggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtcaaaaaaaaaaaaaaaaaaaaaaa

SEQ ID NO: 535 - DNA, 1217 bp, Homo sapiens
cggcacgaggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcatgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaaaaaaaaaaaaaa

SEQ ID NO: 536 - DNA, 1656 bp, Homo sapiens
ggcacgaggttcacagcacctgatttgcaaggcagctatacaagttcctggactcttgtagttccggagtgtttcacctgaccttaagcccaccccatccatctttaatcaagaaaccatgtgctttcccgcatgcctgtgttcccccctcacgtgtctgctgtctgtgtggaagcctggcctggcgcatgctgtggtgcactgcatgctggaacccgtggagtttgcacgcgtggtacagtatgaggcgggtcacgttttgtagtgtgtgccgtgggctcccgagaaacaagttaaagtgtgtgctgaaatagattttattgacataaaataagccttattgctaaatttaagagaatgtgttacaaatgttttttgctaaacatcagtattgattattctacatgatgtacttattgacataacaacctgaaattcttgattttagacaatttctcctcaagttgattcagctgcatgactctcagaaatcagtcattttttattgtagattgctggttttcttcctctagtttgtatcgtgtattttcctcctgtggagaaaatgtggttggcaagaaatgccatattttaaagctgtatcgtggctgttaatgcagaaaacaccagtgtactgcaggctgtttggcagtggggctggggctgagtgtcctgccctcagtggcctgtgtctgtgctcttgttcgctgacatgcagatacaggggcagatctgagggtttgatggagtgcagaaggccacacgtgtggctttctgtaaatgcagaaacatggaatccttgagcagacacttgtcttctggagcaccttgcatggatttcgcctcctgatgcttcattgccgttaatagagtggtggtggttgtgttatgagaaattttgtctaacctggcttctgaaatttctcaaactaaatattcatgctgttttgtgtttttcttaatgactgaggctagtgatattactcagaaaagtaacagtaacttgggtcttctgagcgtcaggatgttcaccatttaacttgtttctcgttagtgtctagtacgtcggctttcggtagtgtaggtgtgtgttctgtgtcctttcccgtgtgtgcctgcactagtggcagcctctgcttccaggtcagtttagagtagactggctctggtattgctagcaagtagttgctgttacccagtgtagccatgaagcccagctccttggatcttgacatatatgttccaggcaaagtacgtaatccagacgtttctaactctttctagatgattgcaattgttctccatgttgtctgttaggcgttatgttaattctcgatctaacagtgtgcctgtaacatatatggtagtgaagagacatcacatgcagagaccgttttccttttatcaactacaggtccgctatcgacgagagcacctttctgctaggcagtcaccctacttcccgttgttggaggatttgatgagagacggcagtgatggtgctgctctcttagctgtgattcactattattgcccagagcagatgaaactggatggtgagtggagaatgcttcctgaaacagatccgaaaaggcttaaaggaaaattatagtgtacattgatccacatatatattaaaaaaaaaaaaaaaaaaaa

SEQ ID NO: 537 - DNA, 990 bp, Homo sapiens
  misc_feature (834)..(834): n equals a,t,g, or c
ttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctggaataaggatgatattcgttgtggttggcctaccaccataactgttcaaacaaaagaccagtatggggatgtggtacatgttcccaatatgaaggtaattataactggattaaattagcagacatctatatactggctgcaatgactgataaaattttagaaatgccaagtgctgagrgtccatttgttctaccctctttatataaagggtgatgctgaaagtttgtttaaatgacttgtttatattaattagtccccaagtgtccaagttacacctgttttttttgtgagtttgttctttacattttgctacctgttacggggactcaaaggagggataagaaagtatccatctaaagagtgctagacacatacagtgaagcccctcaatatgtattgattgaataaatgcatgaaagaatacatttttaaattttgtgtatagttttgaaagactcaagtacgttctgtgtttggtattactgaaaccacattttaaaaataacactcattaagttagaaatatatgagtttagattgtaaaagaatgaggaattgaaatagttgtataccatattgatgaatatagagtttttaggatacctcttacctgaaatattaataataatgtttncagagcatattatacataattatttgtgatttaatctgttaatatgaatatctcatttaaaacttttatttctgaaaaaattatattgaataaaattttatataggcagtccccagccctttcctccttcaaagttgtcttatagagtgattggtt

SEQ ID NO: 538 - DNA, 2072 bp, Homo sapiens
cccacgcgtccggcgttttacgcaggctgtggcagcgacgcggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaggcatcagtcttactacctgtcccaccacccccaccttagggaaatgtcctagaatcctgggaaattgagggcttctttgatggtgagtggagaaaagatagaggagaaggttgcccctgaagtgctgttaggagaaggaggatagaggaatcagccttaggagggttccatgccagctgtcatttggcaaaggaccctggacagatgacttttgcctctgaacttcactcttctctttcctcaaatgggcttcataatgctttccactcaggcttaacatgagaattaaatgag

SEQ ID NO: 539 - DNA, 2543 bp, Homo sapiens
  misc_feature (2538)..(2538): n equals a,t,g, or c
ctccgttggaaacttgggctgagtaccgcggcgggcgcgagcraggcgccctagacatcttctccctcccttgcctcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgraattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaascgtaatgttattgaagctgtttatagtagactgaatccacatagagaaagtgatgggggtgctggagatctagaagacccatggtagccttaaaaaccttctaaaatgcttttrattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaawwwwwttccamttttacctgtattaccaaactgggttctccaataatgtccaaattgtaatgttgccttgcttcaagataaagtgtatttgggaataatattataaacccttmcaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagttttaattttttcagcttttaagatacgagttttgtgtaatttggtatttttaatcatttatgttattttaaaagctcagaatatcacattgaaattactataaatacatttaaaattatctattttagatctaaggaaatactacagagatattttcatgggttcagtaacttttcattttataacattgggcacggtacagagtgattgtcacataaggtacttgaagatttattagtttaattctatttttacagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtagttgcccttgtgnaggtt

SEQ ID NO: 540 - DNA, 1461 bp, Homo sapiens
aattcggcacgagccaaatgattatccttttaatcatgttctactccaaaaatatcagcctgatgatgaatttccagcctccgagcaaagcctggcgggcctcacagatgatgactttcttcatcttcttgctctttttcccatctttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaaaaaaaaaaaaaactcgagggggggccccgg

SEQ ID NO: 541 - DNA, 559 bp, Homo sapiens
gattcggcacgagctgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaaaaaactcgagggggggcccggtacccaattcgccctatagtgagtcgtattacgcgsgstcamtggccgtcgtttaca

SEQ ID NO: 542 - DNA, 819 bp, Homo sapiens
aattcggcacgagggaaactcatgcacaaacaaaacagcacatgctgtactcacagccagttacacagaatgctcatgcatgcatctgttgcttattaattttcttcctgctgtttgtatcattcttttgaagaatctccagcaagctttgtgctttgcccaattgtttataatgtctataaatcaggggcttggaccaaatgaaatgtcttagtagtgtttgcaaaatatttggatattctgattgcgttttattttcccagctttagaaaacatatagatagcctctgttgggaacttatattctcgttactccttgtctcttttcttttttcaggaattggtcactctttcagccaactcgtaggttcaaacaatgtttacatgtagtgctcagtttgttttaacttcckgctgtagacattgacagtttttycttccyaagagtcttatgaataggcaacaaaccaaaaccaaaacaggcaagtcccatctattactacgtacttacaaatccaggtgaaagtgcttggtgaacagtctatgttttagcaactgttttttaacgtttggttgtgacattttttaacaacagccattgttcaattgttaaactatgtttggatttgaggtctgaatgagctgaattcaaaatatgggactttttattagaaaccctggtaaagtggacactggggaaaaagcccaagatttcatgtgtttgatttattgactatgtgcgtcaacagcctgcttttaattctcagagtaaaataaaaatactcagaatctaaaaaaaaaaaaaaaaaaaaaactcga

SEQ ID NO: 543 - DNA, 1414 bp, Homo sapiens
ggcacgagccttgagctagcatttcattatgaccgtgatttttccccgcaccactttccagccttgtggtccacaattccactgggccttaagtatgtactgaactttcctgcctccctcattttgctctgcttgtgcaattttttccaccctccatctctgtcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaagtgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatgctgtatgattccacttatgtgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacacttctggtctcaaggattttggataaaggatactcaatgtgcaacatgtagaatggtggttgcaaggtgggaggagagaatggagagttactgtttaatgatacaatgtttccgtttgggaagatggaaagttttggagatgtgtgatggttatggttgcgcaacaatgggaaggtacttagtactgcttaactgtgcacacttaaaaatggtaaaaatgataaattttgtgtatgtcttaaaacaataaaagaagttttttaaaaaaaaaaaaaaaaaaaaaa

SEQ ID NO: 544 - DNA, 1340 bp, Homo sapiens
ggcacgagaaagaaaggcgagagaaaaatcaaggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaagaaaaaactcctttttatttttactttctttcagcattgaatttttgttgtgtgtatggtgacttctgtttttgggaaacggaagaagccagcagcatgctgaattgtcctgacaggcttccgctggctcttgccgaggttagcagtgctttttttgtatttaaaccatctcccgggcagtgtaaaaagtttgcaggtgcggacattctgtctgactggtctcggcagtgctctataaccctgttgtgtttcttgataaaacacagccccaccctttaataaagcaaagattgctatgaaaccagagagtctattcattactgtggagtaactagagcagtctgtagtgactagacatacggcaattaggaagtcatggagttgggatttttgtcttaattttggctgctcaaagtgccccctgtaggatattcttttttcgggaattgtttccaaacttgcctgtctttatctatggtgaaactcaagccgctttttaaggcaagcctgcaaacccaagtatcaacatgggctcctgaaggcacagggagcagattcacagttctgaccagtgttagggtccccacgagggccacccatttgaactcaaggttggcagactctggccccagcacttgccgtggtttcaggatggccagcggtgacacagggctatggaaccctgggtcttcatctcttcccatatcctttgtttcaccttctttttgcccatattttattgtgcttcagatagaaattttatttataagataaaaagtagctctgaggctgggcacggtggctcatgcctgtggtcccagcactttgggaggccgaggtgggtggttcacgagctcagcagatcaagaccatcctggccaatatggtgaaaccctgtctctgctaaaaatacaaaaattggctgggcgtggtggcgggtgcctgtagtcccagctactcgggaggctgaggcgggagaatcgattggacccaggaggcggaggttgcagtgagcctagatggcaccactgcgctccagcctgggtgacagagggagactgcctcaaaaaaaaaaaaaaaaaaaaaaaa

SEQ ID NO: 545 - DNA, 1676 bp, Homo sapiens
ggcacgaggggacttcagaaccacagaactgagatgataaatgagtggtgtttcaagttgctaagtttgtggtcatttgcttacagtaattgtaaactaatacacaagtgtaagtttgttttcttaaagaagaaaaaaacggggaaggaggtaagtgttaaaggatcaaaactctgacaaaaggctggttgcagaacatgacaggttgttgcactggaaactatttgtcatgcaagtttatgttaaaataagtagcttttgaggactttcatttttggtcttgtaaacatgccatttaatattgtccmactgataatactttttgcaaacagaaactgttaaaacctttaaagcaaatattactgtagagaagaagtaatgtgttatgaaactgtgaggatactaagaaggatcctacttaagtttcttcagcataaataaacttgagcgtttcgaccactgttactgagaatgaaattatttcttaatcacttttaatgaggtaaaatttacatacgataaaatgcaccaattttaaagtatagtttaatgagcttgcacagatgtaaatatctgtttaacttctacttaatcaagatatagaatatttccacaatgccaaaattgccattgacccccttccccttctttcacccaactgcagaccccaggtcaccaccaacctactcttgctcaatatagatttaatgtgatgtgtcttttctagagttttatgtcaatagaattgtacactatgcactcttccatgcctggctttctttgctcagcagraggtgtttagattaattcagtagttcatttctttctagtaatgaataggatcacattatacattataccacagagtgtgcatccattactttgtkgattgatatttgggtcatttccaggttttggctattgtgaataaaactgccttgactattcctgwacaagtctttgtattaaggaacatacgttttattttctcttgaggaagttcctagcaataagattgctgggtcatatggtaggtatatatttagctttaaaagcaactaagtgctttccaaagtgactgtacaatttaacattcctacctgaaatgtaagagaattccagttgctccacattcttgtcaacccttggtagcatcagtctctttaagaattctaatggatatgtaatatggactataggtttaatttgcatttctctgttgactaatgatgttgcacaacttttcatatgtctatcaaccattcttgcatcttcttttatgaaatgtctgttcaaatcatttgtccactttttattgtgtcattttattcagttgtaagagttctttacatattctggaaacaagtcctctgtcacatatataggtactttgaaaatctgtgctttgcctttacatttttttaatggtaactttttaagagtagatagttttggttttgatgaaattcaacttatcagtttttcagttatagtatgtatttttatgacccatctaagaagcatctgtctacccagagttgcaaagatatcccttttcttactagaaatattatagttttatttaccattgcttctatgatacattttaagttaatttttgtgtattaaatgaataaaaagttgaagttcaaaaaaaaaaaaaaaaaactcgtagg

SEQ ID NO: 546 - DNA, 1747 bp, Homo sapiens
ccacgcgtccggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagcagcctctgcagcccaaacgtcccaacggtgcctggaccatctcttctgatgagacgaatctcattttcatttccattaacctggaagctttcatgaatatttcttctttaaaacattttaacattatttaaacagaaaaagatgggctctttctgggtaggtggtacatgatagcagagatatttttacttagattactttgggaatgagagattgtgtcttgaactctgcactgtacaggatgtgtctgtagttgtgttagtttgcattaagcatgtatacattcaagtatgtcatccaaataagaggcatatcattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgactgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcaaaaaaaaaaaaaaaaa

SEQ ID NO: 547 - DNA, 1251 bp, Homo sapiens
gacccacgcgtccgagcaaacccaggaaggtgtggcgtccccgcttcgcgccaagatggtgctggtgctgcgccatcctttgtgtgcccgggaaagggcgttccgggagccgggtcgggggctcctgactcgcactgggcagcatgacggtgcgccggctgtcactgctgtgccgggacctctgggcgctgtggctgctgctgaaggccggcgcagtacgtggggcgcgggcaggtcctcgcctccccggaaggtgttgtggggcgacatgcggggacgccgggcgggggtggacgttctgggcccagccctgtcctcagaggctgctggggcagaagcccggggctgggggatgccggggatgggtgttggggtgggtgcctccgagaccagaggagccctgttccttggcagggaaggtgtgcacgggccttgcccgatggatggtttagggccatggccctggggtccctggtgagcagtggggccgcctctgcccttggcctgtgagggactgtctgtgctggtcccagaaggctgggatcacctttccactggctcctttgttcgaggtttttcatagacaggctatgtggacaaatgagggcagcgcccacgtctggctggtggaggggctgcggctcctccttggaggggacgcctggccactgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtcgggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgttaaaaaaaaaaaaaaaa

SEQ ID NO: 548 - DNA, 1539 bp, Homo sapiens
cgatggccccgcggccgctctagaaagtcccgttttttttttttttttttttttttttttttttagagtacgttctgcattttatttytgcaggcaacactttgctcaccagcaagaacacagcccraggaagggacccaataacctttcaaaacscaaactgctkcctgcggtgagggcccagggtcctccacggagaggacaggcatcttcctttcccaccaggaaggagtcagcccggagcctctgctatgtgcaaggcggtgtgcaagcaccggctgcrgctytttgctgtctcttctttctctttggggctgggctgggtgtgcgttctggtgctgatgctttggcctgtgaggctgagcttggcacctcgacccgttcaattacagcaacgaagaagccactgctgagtgtggtctcaggggaggcccggaggcagtgctcggcacccgggaacgtgctcaggcctcggtggggccaggcaggcagggcgggagctagcctgaaggcgcccgggttctgctgcagcgcatctcgcaccacgtcttcattctcctcctggcagagggagcacgtggagtagacgagccgctgcagggaagggaaagtgagcgcgtggcacagggctcgctgctggaaccctgccagggcatgcagacgcaccgggctaggtgtgcctgccccgggctcctccagctgtctgctcggcatacccgagccactgcaggaaggatccagcaggayrtagtggacctcaygrtagcgyggatcyragggggagaccgccaggaagtcctcctcagccagytcacagcargagacgccagcccrggccagcagcgtggccatggatgccagccgcttggcatccaggtcaaaggcaaagatcttcccttggttcttcagaagagcagccaagtgactggtcttattgcctggggcggcacaggcatcgatgacatgggagcctggcggggggtccagcagcatggctgggagacagctggccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctggaagcccgaccctgataggagaaaccttgtctcttgaaataatcaactacatcatcggagcaggtcttgagagtgttcacacgcacaaatcgaggcagctgggaggctggaccaggcctggatcccacttccaacaggtcctcattccggctcacaccccgatgaaccttgagccgagccaactcagccttgagcctcgcctggtgccggcccaacagagccttccatcggcccccaccccctcgaaagccctttcccaacaacaactcatacactagcaccttggccaggtgcggccgctctagaggatccctcgaggggcccaagcttacgcgtgcatgcgacgtcatagctctctccctagagtgagtcgaatgaggttcata

SEQ ID NO: 549 - DNA, 1941 bp, Homo sapiens
tcgacccacgcgtccggggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccttctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggc

SEQ ID NO: 550 - DNA, 2077 bp, Homo sapiens
cccacgcgtccgcggacgcgtgggcggacgcgtgggtaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctgatttttatgtgttcatttatgaacattaaatatgaaaatattatggtttatattatttattgaaggagtagaggaattactcaactttagtatgctcttaattgaatatatggaggcatttgactttctaatttgtatatttttatattatgtgaattttaaaaatgagctttggaattttttaatttatagaaaaaaaaaaaaaaaaaa

SEQ ID NO: 551 - DNA, 1567 bp, Homo sapiens
  misc_feature (36)..(36): n equals a,t,g, or c
acacgggagcggcgcgcccgggtcgacccacgcgtncgggyccggygccgctaactggagcgaaccccagcgtscgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtaracccccagcagcccttcaaccctcttcttttcctgcccccagcgctctgtgacatgacagggaccagcctcatgtatgtggctctkaacatgaccagtgcctccagcttccagatgctgcggggtgcaagtgatcatattcactggcctgttctcggtggccttcctgggccggargctggtgctgagccagtggctgggcatcctagccaccatcgcggggctggtggycgtgggcctggctkacctcctgagcaagcacgacagtcaagcacaagcttcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtratcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctggragsccttccatgcactgcagatccttggcttcctcatactccttataggcactgccctctacaatgggctacaccgtccgctgctgggccgmctgtccaggggccggcccctggcagaggagagcgagcaggagagactgctgggtggcacccgcactcccatcaatgatgccagctgaggttccctggaggcttctactgccacccgggtgctccwtctmmctgagactgaggccacacaggctggtgggccccgaatgccctatccccaaggcctcaccctgtcccctccctgcagaacccccagggcagctgctgccacagaagataacaacacccaagtcctctttttctcactacacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcataaaaaaaaaaaaaaaaaaaaagggcggccgc

SEQ ID NO: 552 - DNA, 1510 bp, Homo sapiens
  misc_feature (426)..(426): n equals a,t,g, or c
  misc_feature (454)..(454): n equals a,t,g, or c
cacgagaaacattctatcttttatcaaatgtgtgattcataacttttggataccaaaggaatctaacgaaataaccataatcatcaatccatacagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctggagtcaaagccctactttctattactcctcgggaactgtgctaggtgttctaatgacatagtctttgtcttgctgttggtgaaaagattcatccgaagtatagcaccttttggggctctaatggttggttgttggtttgcctcagtttatattgtatgccagttgatggaagatctgaagtggctgtggtntgaaaacaggatatatgtatcaggctangtcttgatagttggatttttcagctttgttgtttgttacaagcatgggccccttgcacacgacaggagcagaagtcttctgatgtggatgctgcgactcctctccctggttctggtctatgctggtgtggctgtgcctcagtttgcctatgcagccataatcctcctcatgtcctcctggagtctgcactacccactgagagcatgcagttatatgaggtggaaaatggagcagtggtttacatcaaaagagctggtggtgaaatatcttacggaagacgagtacagggagcaagctgatgctgaaacgaacagtgctctggaggagctacgccgggcctgccgaaaacccgactttccctcatggctggtcgtctccagactccacactcctagcaaatttgcagattttgttcttggaggaagccacttgtcacctgaagaaatcagtctgcatgaagagcagtatggccttgggggtgccttcttggaagagcagctctttaacccgagtactgcctgacatgcgaccttcaagttgacttcattctggacaaggaagtgggcaaagggcaggattctattaaagttaggcagaactgttctagtgaacggtggcaaaaacatttgctgtggagaaaaacaagtcagtctggaaaggaaaaccaacccattttgaagataacttagcattcttggtgacttctgctacttattgtactgtaggtggataccaaaattctgtgacagccactaccacttaccttgaatgaaggctttcattaggaacaggggaatggcgttgttcttaaggggctagtaagcatgaacaggtgctttgtcgacaccagggcactaaatctggtcttaatcccctgaacctgtgtcagaagactctgcaatactcttcctatagttcgtcagtataagtccttaaagagacctgagacatgctggaccagtgttttccaaagtacagctcacaggctactaccaagtgttggtcaataaaggtattctgaggtcaactaagattgataaaaaaaaaaaaaaaaaa

SEQ ID NO: 553 - DNA, 805 bp, Homo sapiens
ggcacgaggtccctaattgtcttgtacctagccctagggtgaccagggcaggggaatcatggcgagaagcgtaagggcctgatgaagaaggtgtgctgggtgtgggctctagcccacttggttttgtgtgagaggtggctgacagcaggttgtttgctgtatgtaggagttatccagccctgcaagggcagtccctccagtgtctgcaaagcccgaagatgtctgcatccaaaatacagaataaaaagatatggttactacaagtactcagtaagactgataatctgtcatcatcatcctcatgcccttaaagcagagctaactgatgattaatatatgcttctatgttaacagtcttggactttattaatggtgggtggaagttaacttaatgtatgtatgcaaactaaaaagtggcatccttttcattaatgacccaaccattattcaagagctatgtctagttagggacttcagacttttgaaagaaatgaagaaataatgccagatacatgggctcgcacttggaatcccagctacttgggggaccgaggtgggaggaccgcttgagcccaggagttcgagaccagcctgggcaacatagcgaaaccctgcctcagttttaaaaaagaaaaaaagaagtagtgaagaaattggaaaggattctgagaagaaatatgcaaggtggaaaagagcctagaaagaaaggtgacagatgctgggatttggtcgtcagaagagatatctaggaaatagcatggcagccctcaagtactagctccacttaaaaaaaaaaaaaaaaaaa

SEQ ID NO: 554 - DNA, 2108 bp, Homo sapiens
ggcacgagggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtttcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaggccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccaccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctaaaaaaaaaaaaaaaaaaaaaaaaaaaa

SEQ ID NO: 555 - DNA, 1182 bp, Homo sapiens
ggcacgagcccccagcacatggaagccctgttacagtccctcgtgatagtcttgcttgggttcaaatccttcttaagtgaagagctgggctctgaggttttgaacctactgacaaataaacagtatgagttgctttcaaagaaccttcgcaagaccagagagttgtttgttcatggcttacctggatcagggaagactatcttggctcttaggatcatggagaagatcaggaatgtgtttcactgtgaaccggctaacattctctacatctgtgaaaaccagcccctgaagaagttggtgagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtgcctcccccctccctcagaccagtatccaagagaagagatcaacagagtggtccgcaatgcaggtccaatagctaattacctcaacaagtaatgcagaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaaaaaaaaaaaaaaaaaaaaaa

SEQ ID NO: 556 - DNA, 1146 bp, Homo sapiens
  misc_feature (5)..(5): n equals a,t,g, or c
  misc_feature (857)..(857): n equals a,t,g, or c
tccancattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggnttcttttgtggaattgggtgcaaaccaggcctaccatgagttactattaactgttttgkggtatggkgtkgkccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggsactattatggaaacagtaattcaaagagagttgctggaaagagtgaaaatgcag

SEQ ID NO: 557 - DNA, 1998 bp, Homo sapiens
ggcacgagaacaatttcccttgtacataatatacttatgtacttataccattgactctgtaagataaaagtcttagaaatggggttgccaagtcaaagggtctatgcatttaacacagggaatgagtactgtcacgtggcttctgaaactgtttacccagtttatgttcccaccaacagtgtctaattcccatacctgtgctaggtattatgtctttaatttttgtctgattatttcatttaattttaatttccattatcactggtgaggttgggcttctgttcagtttttttgtcatttatgtttcttttgtgaattgccttttcctatgctttgtgcatttttctcttggggtttgtctttttaaaattgatatacaggtgttctctataatatagatattctgccactatatgcaaatgatcttccaatttatttatttatttgaaacagagtttcactcttgtcaccaggttggagtgcagaggtgcgatcttggctcactgcaacctccacctcccaagttcaagcgattttcctgcctcagcctccctagtaactgggattacaggtgccctgccaccatgcccggctaatttttgtatttttggtagagacggggttttgccatgttggccaggctggcctcgaactcctgacttcaggtgatctgcccacctcagcctcccaaagtgctgggattacaggcctgagctaccgcaccggccccaatttatttcttttaacttagtttatggtgcctttagctgtacaaaagttactaatttttagtcaaatatccagcttttcctttagggcttcttatatgtcctgatccaaggattattttttaaaaattcttccgtattttctcctataatattcataggttactttacaattagatttttaatacatctcctaactttttcatatagtatgaggtatccatttttaaaaaatggatatccagttgtgcccatatgtcttttccactcatctgaaatgccaccattatcatattttcaattttcatgtgcacgtgggtctgttttcaaacttggagattctcttccactgatatatgtctattcttgtgccagtggtttaactgctattgctttatagtatattttgatatcttcttttcaaaaggatactcttgtgtattctttttttcatcttgtgtattctcatccattttccagaaaaccacagaatcaactttaagtttcatttcattaagtcagattagtgagagctgattttctgtgtatcatgttcattcagaaacatagtctatctctccatttaggggcacttgttttatattttctttctaacacgtattttgttgggtttattgtaccttttttttttttaacttcagattcaggggggtgcacgtgcaggtttgttacctgagtatacgatatgatactgaggttggagtatgaatgatgccattacccaggtactgggcataatacccaatagttagtttttcaacccttgcccttctccctctctcctccctctagtagtccccagtttctaatactgccatctccatgttcatgagaacccagtgtttagctcccacttataagtgagagcatgttgcatttggttttctgttcctgccatatcctttgtagggacatggatgaaattggaaaacatcattctcagtaaactatcgcaagaacaaaaaaccaaacaccacatattctcactcataggtgggaattgacaatgggaacacatggacacaggaaggggaacatcacactctggggactgttgtggggttggcggaggggggagggatagcattgggagatatacctaatgctagatgacgagttagtgggtgcagtgcagcagcatggcacatgtatacatatgtaactaacctgcacaatgtgcacatgtaccctaaaacttaaagtataatataaaaaaaaaaaagaacaaaacttaaaaaaaaaaaaaaaa

SEQ ID NO: 558 - DNA, 600 bp, Homo sapiens
agaactagtgatcccccgggctgcaggaattcggcacgaggacctctgaccatcaggcttctgggaaccataggctatacccacaccacagagcatcgataaactattttgatgtttctcttgctttcagaaagacagcttccaagattcaagcccaggtggtgccggtctttttttggaggtgctaattaataatttaacttcatctaatgataattttatcttgttgcagtttgtggatttatgattatctcatccatccggtgcctagtgttgggcatagagtgtgtctctgctgtctgccagaatctgctactgggagaatttccccactgggagagggacccaggaaatggcatggtcttagaaggtctcctgaacacatttccttgggagggctcctgttatcttcaaggttgatggctttctgcaatctctcaagggctgttttgcctggaaacaggacgatggagacagagacctatcagctgtgggcatctcaatatcagcggaaatgggtatcaagaagtctcagccaggtgcagtgcttgcgcctgtaatcccaacactttgggaggctgaggtaggtagatcactcga

SEQ ID NO: 559 - DNA, 777 bp, Homo sapiens
  misc_feature (274)..(274): n equals a,t,g, or c
  misc_feature (278)..(278): n equals a,t,g, or c
  misc_feature (295)..(295): n equals a,t,g, or c
  misc_feature (676)..(676): n equals a,t,g, or c
ggcagagctcaggtaagargcaaaattactagaatattcactctcactgaaaatgagtaaaaacctaacttagatgaaaatccttatcttgttcatttttattcctggccttttggttgagaagaatgggccagaccatgtgtgtgtgtgtatgtgtgtgcgtgtgtgtgtgtgtgcgcacttgggtttatttatatgagccggtaaaatttcgttcaccattaatttatgttaatttaccaacttcttaaatgagaacagtgagaattttctncatngttaataatacactggncagtgcatatatgcatcacgaagagaggattttcccattgataatagatttccaaatacatcttcctgctttaagattttaatatatggatttatatataaaaactagttaagtcattggaaaagcaaactgtcawccttctcttatttgagawctcaactttagaaagtctatgttctcaactacagaaaataatttttagaccagctaactttcagatttctgcagtgcttattttctcccagttgagggttggtttttgtttgtttgtttgtttgtttgtttttcctgattaaaaagtaagaatacggccaggcgcgatagctcatgcctttaatcccagcattttgggaggccgaggagggcagatcacctgaggtncaggagttcgagaccagcctggctaacatggtgaaacccagtttctactaaaaaaaaaaaaaaaaaacttcgagggggggtcccggtacctaatcgtccct

SEQ ID NO: 560 - DNA, 1037 bp, Homo sapiens
cggcacgaggtgatacttctgaagactgcagggagaatccgttttccagcttttttcatccaccagaggccacctgtattccctatcccacaaccctagccccttcctctatctttgaagtggactatttcatcccctgtttctatcatgacagtgccttctctcatattgaccctcttgccttataagattccttgtgattacactgggtccacctgcataatcaaggctaatctctccatctggagatcttaatataatcacatctacaaagtccctttggccattgaagtaacatatttatatgtattcattattaggatgtgggacacttttgtcagggacagggatttttcagcctacctttttcttcaccttttgccaccactctcagcctgtggtctcaattgccagcctttacacttgctaccccattgtctgggtagttcataccagtcctcaagactagcctcaggcatgcctcttctgggaatacatcctcttacaggccaggatatgactcatgggtgcatcctaatagcacttcacttatttctactgtcaccacactgatctgtaattacttgatttgtctgactcttctgggggcttgtaagcattctggcacagagaactatgacttactggggcttacatctcttgctaaacacagtacctaaaatttagtaggcattccctcataaacatgaatgaatgaatcaaagaatgaataaacatttaggaaatgatgttgtgttggtcaacttctttcctcatcactgttaaagataaaagaatgccaagccaggttgttcagacagaagcaagcaccacatccctgagagagcagcacatctgggcagccatgtgtgagaagtcggttgcattccccatacacagttgtctttgcagctgtactcttaaccactgtaaccacagaagtggggaaacaatagggtggggtgaagtgaaaagaaaattttccaaaacttcatttatctaataaatacagatatttaaaaaaaaaaaaaaaaaac

SEQ ID NO: 561 - DNA, 727 bp, Homo sapiens
gaattcggcacgagagggttttagtttatgtctctaactttagcaaagctgcattcctattggaatgcatactggaaacagctctcattcctacctttaaagggctcttggaaagcagtgtgacaaccaaggtcactaaatggtgagatcatcaagccattttaagttctttctcatgttattcaccagcaccctgcaggacgttgggcacacatcacatccctcagctcagccatccagccgtctcagtgattcaccactcatttgcttaattaatagacaggtttgatcactttgtacatggaaggcactgtgccagtgaacaagcagttggacccagccctccagtagggaatggacagctgaaaatccatgagcaagaaagaaggaaaaagaaagagttctgagcagccaaaccatttctcgatgatttcagagccttcattctgagcatcagttatatgctctccagtgtaatgactttatagccaagcacagtaattgatattactgtgaaggcccttaacttatcaagaaatggttgaggccgggcacattggctcatgcctataatcccagcacgtgggaggccgaggcaggcagatcacttaagcccaggagttcaagcccagcctgggcaacatgatgaaagcccatctctacaaaaaaaaaaaaaaaaaactcgagggggggcccggtacccaattcgccctatagtgagtcgtat

SEQ ID NO: 562 - DNA, 600 bp, Homo sapiens
  misc_feature (553)..(553): n equals a,t,g, or c
  misc_feature (560)..(560): n equals a,t,g, or c
  misc_feature (589)..(589): n equals a,t,g, or c
gaattcggcacgagcggcacgagccgagatcgttctggggctgctggtatggacgcttattgctggaactgagtacttccgggtccccgcatttggctgggtcatgtttgtagctgtattttactgggtcctcaccgtsttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagaaggacagtcacaacttcaacagctgggcggcctcatcgttctttgccttcctggtcaccatctgctacgctggaaatacatatttcagttttawagcatggagawccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgtnacaattnaactgggttactttatttggcaagtgttntaggcttttaa

SEQ ID NO: 563 - DNA, 1242 bp, Homo sapiens
  misc_feature (288)..(288): n equals a,t,g, or c
ttcgtatccactaggatggctctaatcaataacaaagtattgtcaaggatgtagaaaaattggagccctcctgccttggtgggagtgtaatatggtgccagatacaacctccatcctgaagctcatctgtatgcttcctgtttgtgtttttaaacttttactatatctttatgtcctcataagaatatgtactatcatttggtgttttaaagtgtacataaatgctgtcatcctgaacaaatcctctcgctaactgcatctttaactctatactatattttcaagatntgtccatgttgatccacgtagctccctagttccctttaactgctataagatattctgttgcgtcaatatatgacaatttatgcatgctttgttgacaggtaattggatttttagtgttttgcctttacaaaaatcactgcatcttttgcacatgtctacttgtgcatatgaactgaggtaaaattgctgggccttactgtaaatatgttgttttaattcactttgcgctgctgtaacagaataccatagactgggtgcttataaagaaaagaaatttatttctcatagttctggagaatgggaattccaagatccattcacaggttcggttgtctggggaaractttcttcacacatcctcacttggcagaacggaagggcctgggttgatgctgtgtgaamcctcttttataagggccttagtctcattcccaaggaggagctctcataacctaatcacctcttaaaggccccccactcaatactatgacattgaatttcaacatctgaattttagaggggacactgcaaacctgtcatatgtctttatctttactatcactaaattgtccaaagtgattgcaacagtgatttatatactcaacccacagagtataagaatttctcctttctagctgggcacggtggctcacgccagtagtcccagcactctgggaggccgagatgggcggatcacttgaggccaggagttcaagaccagcctggccaacacagtgaaaccccatctctgctaaaaatagaaaaagttagctagctatggtggcgcacacctgtaatcctagctatttggggggctgaggcaagagaattgcttggacctgggaggctgaggtagcagtgaactgagatcgtaccattgcactccagcctgggtgacagagcgagactctgtctcagaaaaaaaaaaaaaaaaaaaaaaaaaaaaaactcgta

SEQ ID NO: 564 - DNA, 970 bp, Homo sapiens
ctcgtgccgaattcggcacgaggtgcccaggctctcagggcagagggtccagtgtgatcactttgcatggcctctctcccctcctgagcttgtgccagggccccagggctgacctggagaggaaaawggcagagggtgaagatggggtgtctggtttggggaccatcctggccccccttgtcactgttggcatctcttctgcacagtggcattgctgggaggtgcttactgtgcctattcaaggggctggcagccgcagcctcactgcagatcagggacttggcttcccggttgaccacaggtccaagaacctgcagggtccagcctcccccccatccccagtcttccccaccctggcccggccctccaggtgcagaaacatgcaggcccctctccaggactgtgggaggagtgtgtccctcagactggcctgtgtcctggctcctcttaccacctcttccagaggttgtcacctgcagctgccccaggataaaggcaaggccagagaggactcctgaactcctgtgtgcctggggtggcaggggcaaacatagccaactggtggcctgagcggggccatggtgargacacccttggtggcttgtcccacatcaagctgggargtgacactgaggatgcattagtctgcagcgtatgataaaaacggcatttcaggccaggcgtggtggctcatgcctgtcaccccagcaccttgggaggccgaggtgggcagatcacatgaggtcaggactttgagaccagcctggccaacatggtgaaaactcatctgtactaaaaaaacaaaaattatgtgggttggtggtgtgtgcctgtaatcccagctacttgggaggctgaggcaggagaatcacttgaacctgggaggcggaggctacaacgagccgagattgcaccactgcactccagcctgatccgtctcaaaaaaaaaaaaaaaaaaaaaaaaactcga

SEQ ID NO: 565 - DNA, 1388 bp, Homo sapiens
ggcacgaggtaagttgcaaggtacacccacgggtgatttatcactcttacaaagatgataactaatgaagaccgcatctagaatgctcttactggagatggtttacagagcatttttaatcatcatacttagatttatattaatatttcttttcaaactaaattattccaaactgtgccctgagataccatttggcctcaagttcttttctttcgtctgtattaaggtgcaaataaaaaagactagtaggaaaagaaggccttatttatgaaggttgtctatagctctgagcttggtagctacataaaatgagtaataacctaaataagtaaaactaatgaagatctaactagattactttgcttaatattaacattttacccgccccccgccgtgaaacatttggcagatgttctgcaggactcatgaggacattggtggctacagctgcttctggcactgcccccccaaccccccagtgaggtgaacttctttacacatccagcaagctttagttatcttcttctcccatttgagataactgtggctacaagaatctcagttaaatcagatgtttaaattaggtgccaaaaaatcttacagacactgaactaatacttaaatcaaggaacacttcagttctccataaaatctggtgccattttccaaagaaacagaggatctttgtttcacacccgtggtactggaattgcaacagtgaggcattctagctctcacatgccaatgcgagtggcattcattcttgctcactcatttctgcttctcattgtcacacttggaggctctttgggggtatgtttcagttgatctgagaaactgggtgttaccaatttactagagagtttcttaaaatgtatctgaaacaaactattaatgggcattctgtggtggtaaaaccaggcaacgcctccctacactatctgtcctttcagagctaagaatctgttattttgaattgttcacgaagagtgattctgactctgcttcagtgcacactttacaaaccatcgagcctcatcaaaggagtgagttgagctgaggaattagagtaaagaatacaggtatagtgccgggcgtggtgctcacgcctgtaatcccaacattttgggaggacaaggagggtggatcacctgaggtcaggagttcgagaccagcctgaccaacatggagaaaccctgtctttactaaaaatacaaaattagctggacgtggtggcacatgcctgtgatcacagctactcaggaggctgaggcaggagaatcgcttgaacccaggaggcggaggttgtggtgagccgagatcacgtcactgcactccagcctgggcaacaagagtgaaattccatctcaaaaaaaaaaaaaaaaaaa

SEQ ID NO: 566 - DNA, 649 bp, Homo sapiens
ggcacagggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtaaaaaaaaaaaaaaaaaaaaaaaaaa

SEQ ID NO: 567 - DNA, 1699 bp, Homo sapiens
  misc_feature (9)..(9): n equals a,t,g, or c
  misc_feature (1692)..(1692): n equals a,t,g, or c
ggcatcttntatttagcacaatgtttttaaggtttattcatgttgtagcaaggtacgcaattgtttttcatttaaagaaaaagtctcaatgctattacaattttccatattctttgcacctgtggtctgtctccctaaatatagcccctttatgaaggaggaatgcaaagctgatccaactagagactacaaattcctttatatttatatagaaaggggcacatagtaatgaattggaagccatatccaagctagaatcatctagatttagtgagattgactagtgcaacccaattttttgcactcatcccctgtccatcaggtacctggaaatgattryaawgattttgaactaggttactggtataatcatactgctgttgagattagcaggcaaattaccaagttagttttttattggagggggagaggtcaatgtgtgagggtgcatagtggagactggggaccaggctgacaaagatgaattgttttaggtagtgatgactttgaggtaatgggataagtgagtgaaaatgactggttggcgttggagatgggatggagatggagcttggagaaaaagaatagcactagtaaatggatttagctagacaaaggagatttaccctattccatttagcacagtgaggagaggctagacagctaggatgcaataaaaaaaattttaatgagaaatgtgtgtggtagattaattttattaatctcaagttatagattaaaaaatttaagtaccacataaatgccatttgcctttgctaatgttacatttttatgaagaaggagccttgcataaagaatgatataatggacttttgggacttgagggagaagcttgggagggggggtaaaggataaaagacatattgggtgctgtgtgtacactgcttgggtgacaagtggactaaaatctcagaaatcaccactaaagaacttatctacataaccaaaaatcacctgtaccccagaaactattgaaataaaaaaaaagaaggggacttggacagatagccgtattctttgccaaattatagttacattctgctcatgggggattaggaggttcaatggaagaaaggccccactcagctttctcccctcttaaaatgttgccttgtaaattagggaattttgcataaagctctgacctttacttccaaggcctttactgagaatgggtttggatacttggagatagatcctgactccctatccctcctagatctttatttatcctatttggaacccagggaaatggccttaaagctgatgaaccacagggtgtccaagtcatggagctattgaggttctccccaagtatcttttaaattgctgcatttgggatgggcgcagtggcttacacctgaaatcccagcactttgggaggctaagttgggaggattgcttgggtctgggagtttaaggccagcctgggctagatggtgagcctctgtctctatttaagaaaattagaaattagccaggcatggtgacacaccagctacttataatgctgaggcaggaggatcacttgagcccaggagtttgcggcagacagtgagctatgattgtgccactgtactccagcctgggtgacagagcaagaccctgtctcttatttaaaaaaaaaaaaaaaaaaaaaactcgagggggggcccgtacccaatcgccttncatgatg

SEQ ID NO: 568 - DNA, 433 bp, Homo sapiens
  misc_feature (424)..(424): n equals a,t,g, or c
  misc_feature (430)..(431): n equals a,t,g, or c
cggccgctctagaactagtggatcccccgggctgcaggaattcggcacgaggcgggaaggcttattccaaggtaagaggggctgtgtgaaggggcagtgggatggaatggggggtggcatgggacaggcacaagggaagcctccagccccttttctgccacaagcaagaggcactcagccctacctgagatgtgttattttttagaaatatctttattgatggtctttgcactcaatataaaggcagcatatggttgttgcaatataaatggtacagaagtccacagagcaaaagggccagtttctgtcccctttcctctctccaggcctctttctgggaccccattattggatagattaagacctttccagaccttgtaaaaaaaaaaaaaaaaaactcggggggggscccggaaaccaattngccccnnaa

SEQ ID NO: 569 - DNA, 1537 bp, Homo sapiens
atcatataggaaacggtagcctgcagtaccggtccggaattcccgggtcgacccacgcgtccggagcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgactttaaaaaaaaaaaaaaaaaaaaaactcgagggggg

SEQ ID NO: 570 - DNA, 1782 bp, Homo sapiens
tgccgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagc

SEQ ID NO: 571 - DNA, 574 bp, Homo sapiens
tagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaacaatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactataaaaaaaaaaaaa

SEQ ID NO: 572 - DNA, 1205 bp, Homo sapiens
ggcagagcttttgtgcagcaccctttaaagggtgactcgtcccacttgtgttctctctcctggtgcagagttgcaagcaagtttatcggagtatcgccatgaagttcgtcccctgcctcctgctggtgaccttgtcctgcctggggactttgggtcaggccccgaggcaaaagcaaggaagcactggggaggaattccatttccagactggagggagagattcctgcactatgcgtcccagcagcttggggcaaggtgctggagaagtctggcttcgcgtcgactgccgcaacacagaccagacctactggtgtgagtacagggggcagcccagcatgtgccaggctttcgctgctgaccccaaatcttactggaatcaagccctgcaggagctgaggcgccttcaccatgcgtgccagggggccccggtgcttaggccatccgtgtgcagggaggctggaccccaggcccatatgcagcaggtgacttccagcctcaagggcagcccagagcccaaccagcagcctgaggctgggacgccatctctgaggcccaaggccacagtgaaactcacagaagcaacacagctgggaaaggactcgatggaagagctgggaaaagccaaacccaccacccgacccacagccaaacctacccagcctggacccaggcccggagggaatgaggaagcaaagaagaaggcctgggaacattgttggaaacccttccaggccctgtgcgcctttctcatcagcttcttccgagggtgacaggtgaaagacccctacagatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcagaaaaaaaaaaaaaaaaaaactcggggggggccggtacccattygccccaag

SEQ ID NO: 573 - DNA, 1443 bp, Homo sapiens
ggaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttaaaaaaaaaaaaaaaaaaaaaaaaaaaaaaaaaaaaaaaaaaaaaactcgag

SEQ ID NO: 574 - DNA, 462 bp, Homo sapiens
gaattcggcacgagctgggctcaagtgatcctcctgccgaggcctcccaaattgctgggactgcagctgtgagccaccatgcccagccttaacttggttttaagacctctgatttgccttgcctcaattacctcctttcttattttctttcctttgttgactctcatactctgttctcctaattctcccccttttccactccctgcccaccctgaaagacacacacacacacaataagtgggtggagtaagaagtcaacggagttggatataagcattcctgcttttctgacatctccagtgtcttggagaacaaggattctagaatgagggctcctcattatgcttcctttcaacattttttctctgtgttacttaagctttcaccccaagcatgtttgacagagagccagtgcattccccttactttttacaaaaataaaaaaaaaaaaaaaaaactcga

SEQ ID NO: 575 - DNA, 561 bp, Homo sapiens
agggatcccccgggctgcaggaattcggcacgagtctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactaaaaaaaaaaaaaaaaaaaaaaaaaaaaaaaactcga

SEQ ID NO: 576 - DNA, 809 bp, Homo sapiens
ggcacgaggagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctggaaaaaaaaaaaaaaaaaa

SEQ ID NO: 577 - DNA, 1151 bp, Homo sapiens
ggcacgagtgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagatgcgtctacatccatacattactgtgtttggctgaattccactctaatatgatgctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaataaaaaaaaaaaaaaaaaa

SEQ ID NO: 578 - DNA, 308 bp, Homo sapiens
ggcacgaggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctccaaaaaaaaaaaaaaaaaaa

SEQ ID NO: 579 - DNA, 1986 bp, Homo sapiens
ggcacgagggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatcaaatgttgtgttcatgtttggggaaaatataatttgcagaaacctatgaagtagagcaaagatgctttaaaaagataagtttttttgaactaaattttttttagttctaataatgcacataggatattagtacatcgtacacgtgctaggaaaaaacagcttcagtgtctttgtttaatgtgttgaaactcatctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaactttctttatatactttatatattttacattatttctgatttttaaagcaaatgattgccattatgattacactcaacctaaatagttatgaacagtttcagaacaatgaaaaattacaatactatgtgatagtattgtaactatttttctattttagtcatatgtcgcttatatcctaccagaactcttaaatctataatattcgatatattctacaaactgctttattgtagaagccatatttatgtttattttataatgttttctagtgtcaaactgtactgtggagaaaagaaatgttagatctgtgttctgtctgcattttttttgagtacatacccttcaccctcaaaaaaaaaaaaaaaaaaa

SEQ ID NO: 580 - DNA, 1781 bp, Homo sapiens
  misc_feature (1)..(1): n equals a,t,g, or c
ncagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggcaaaaaaaaaaaaaaaaaaaaaaaaaaaaaaaaaaaaaaaaaaaaaaaaaaaaaaaaaaaaaggggcgggccgttttaaaggatccaagtttacgtacgcgtgcatgcaac

SEQ ID NO: 581 - DNA, 1303 bp, Homo sapiens
aggttaaatgcgtacttttctaacctttgttattttgaaagttattctgatattcctatccagttgtgcctcatttactagaaatttgctcacatggccaaatgatgtatccacagaacaatttgaaactagaccttttggaagcgaactcctacaaactgtcatcaatgttagcagaacttgagcaaagacctcaacccagccatccttgtagtaattccatcttcaggtggagggaaaaggtaacatttaaggagactggttgtaatttcttgattgggcctgctgggtggagtggcttaaagtagcatcagggcaaaaaaggtgttaggaattctatgtgatattaatattcatgcagttagttaagaagataaatgttttwatttttcttttgagcacaataacaagagctagacaaaaccgaatacattctgtgtacaccaaacttctatgagaagctaaaaaacacttttgatttcttctttctcatcatacctgaatttcatcctttggatgtgcttttacagtaaaatttctattaaattgaaattttaatattcgttcagacctaaattataagattttgtggtatgtattagtctcatctgtttaagatggtgcctaatgcagataatgcatcagtacagctctgaaatgcttgtagctatttttattactgatcagaagggggaactgtaatcatcttgtgaagggacagttttctaaggctcaagagctcgaaaacaatctcaatcatttacagggttgtgatcatttcacttgcattaagccaactaaagttgtatttgtaaaagtaatgctatgaatattactatttgacctagacacataggttagaattggaaacacaggctataaagtatagtaattgtgtaattgtgaaaatattaaggcttcaactcaaaactgaaacacagtagggcttagaaatctttgaattatttatacccctcagtttaaaaacttccagtccaggcgcagtggctcatgcctgtaatcccagaactttgggaggccaaggcaggcggatcacctgaggtcaggagttcgagagcagcctggctgacacggtgaaaccccgtctctactaagaatacaaaaattagccaggcatggtggtgggcacctgtaatcccagctacgggggaggctgaggcaggagaatcacttgaacccgggaggtggaggttgtagtgggccaagatcatgccactgcactccagcctgggtgaacagggcaagactctgtctaaaaaaaaaaaaaaaaaaaactcgtagg

SEQ ID NO: 582 - DNA, 2118 bp, Homo sapiens
ggcacgagcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaacgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgatagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatcccagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacagagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 583 - DNA, 587 bp, Homo sapiens
ggcacgaggcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggcca

SEQ ID NO: 584 - DNA, 4412 bp, Homo sapiens
aacattagatctcaatgaaaaccagaatggaaccctttcactatcataaactcatttataaaagtgcccatgatgaatagcaagaagtacccagtggcccatctcattgaccaaacttagaaagccaaggtggggcatctgcagctctcccacaatctgagtttgtgttgatccttgtaccccacaacctgaaacatcttcttatatatatcgagcgagctctcagcccttctgttttcaaggccatcatggagaaactggagatgtccaagttccagcccactctcctaacactaccccgcatcaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgtatttaaagctttttcttattttttgtattaattggtaagtgaaaactctgttaaagatcacaccacaatgttttcaagaaacatctgaaaagataaaacaaagaacaaataacttataatacttacttaaattgacactttttgaaatgccagtctgaaaataattaagatatctctgctttgtatgagtttcttttatgaaacttgataccacgggagtccagtaatattggccacaaaagccagagaaagtaccaagcccagctttgttatcatagccacttcctgccctgcttctgttatttttagtgttttttcagatataaatcggggtccaggaaatcctcaccagaatctggcactgcagccaaaggcgatacttccagagttctagtaggctgctatggaatttctggcatgaaaattcttgacccctcacactttaccccctgtacagca

SEQ ID NO: 585 - DNA, 1907 bp, Homo sapiens
ggcacaggggaatcatcgtgtgatgtgtgtgctgcctttgtgagtgtgtggagtcctgctcaggtgttaggtacagtgtgtttgatcgtggtggcttgaggggaacccttgttcagagctgtgactgcggctgcactcagagaagctgcccttggctgctcgtagcgccgggccttctctcctcgtcatcatccagagcagccagtgtccgggaggcagaaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagcggggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattaaaaaaaaaaaaaaaaaaaaaaaaaaaaaaaaaaagggcggccgc

SEQ ID NO: 586 - DNA, 969 bp, Homo sapiens
ggcacgagtagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaaaaaaaaaaaaaaaaaaa

SEQ ID NO: 587 - DNA, 1334 bp, Homo sapiens
tctcagtggtcagaggctgtgttggacccatagtagaattttccagtcacagacccaagcttccatgggttgttactgtgctgtaccacttggtggktctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaaaaaaaaaaaaaaaaaaactcgag

SEQ ID NO: 588 - DNA, 1476 bp, Homo sapiens
  misc_feature (1)..(1): n equals a,t,g, or c
  misc_feature (69)..(69): n equals a,t,g, or c
ncctatttctgcttactgtgttaccagagagcctgggggtctggatcctatctggccccgtcaggtggnattgccaaatgagcagttctcttgccccagtccctttcctgtgctataaataagccccatgtttattttcttatgttattgaaatgagcacttgtgatttgggcctcttttgaggagtccagagagcgtccatccggtgcctggtgagggccctgcatggctggctgctgtctgaagctatttggagtcctctccctgtgttttctatgtggcttaatttcaatagaaagggttatatgcaaccctgtatctgctgattttcaggtttcaactttctgccagcgtcactgcctgcttagaagtaaagttatgtttctcattaaggggataacagccacaattgaggtaattaacgaaaattgtacattggtggcagcacctcctataggatttccaatagtctttctctagtagatcattgggggctcaccttgatctcctctcttctgtctaccctgcaccaaaataccttgtcctgttttctggatatagttccaataatttttttcctaacagcctttttgtcaccagttggtttgatatcttacaacttggccaaatgagggttccattaactccatcttgtctaatgcatggagaattcaaggattttttttttcctcttttcatagcaccttccagttgccagttgtaccctggcccttctttggaagtcataatgatgaatatccattaataagagattgatgctctttcaactctcatgtcatctataccatctcagtggagaggatgactttggatgaggttggaatagaaaggaaacatttggaagtccactgcagtgtattatatgctgtgtggaagtctgggggttaggaaatacctggagggagaacttcctaagaaatgatttttggttcttttaggccttaacagcacaataaaagtatcccatgagaccattatgagcaggacacgacattgtttcacaccttgggctgtgactatttacttctcggtacagattactctggttaaatcactcagtaaagaaatcttttcatgctcacaatctgaacctgaaggctattactgaagagaattgcatctgacaacaaaatttaatttacttccagagaaaggaccagaagaaagtaaattttcatttatgtttttaagtctattgtcttaaaaagattcttttcccttaaaaaataaaaaaacctgatgtgatgggttccttcagtcaacaaatacttattgagcagttattgtgtgccagatactgttcttggtgtgaggatatggcactgaacaaaacaatgtacctactttcgtcaagcttacattctagtgaggaagataaccaaaacaagtgactgaatataatttcaaatgtcaataaatgctgtgaagaaaataaagcagagtattatatgtaaa

SEQ ID NO: 589 - DNA, 2126 bp, Homo sapiens
ggcacgagttgctaagttgattaaaggttggtcttccactctgccactggccacagcacaaagtgaaaacagatgtcacaagcaccttgtagatctgtcccttttttcttctgatgttcaccctccttttgagctctttctttctccaacattgcttacaaaataatctttatgcatctgagagggagcaaatattcagtaactttctgcagctgtcctcactaaagaggagaatctgttgaatgccactggaaatgtaaggatctcttgtgacagtaacatctcaaggggaaactagtggttaaattgttaattctttgagtctgaaacttttttcatttgcagtgcagataagtgcctgatcttgcagtatcacgtttctgacttctttgttctggcttcattttttttttcccaaaatgccattttcatttgttcttagagttcagaacatgtcaaagagcttctttaagcagtaggtggttttacagagcccacagagaaggaaaactaaatatcatcccggatgcagtccactacgatcgtggaggagtcagattactctccgggctttgctgtgtctgcttgtgaaacaggaaagggagaactgaggcaatgagtcacctcacttgggcccaaagcaccacctacgttgaatatggagaaaatgtgaagcaagagtttctttttatacataatcaccatttgtacataatcaccattttctccatggttcttatccaattcagtgcatcttaaaggatggtttgtggaatcatgacatagcagaaaaatccaggtactatcagtcttgcctgtttctacctaactctttcatttaaactctcactagaatctataggaactgttagcatcaattttaataagttgtcaactaagtgattagtggtatttattggttatttttgacaaaataatggaatcatcaaattttgaagttgagaagtaaagtaaaaatttgtgccaaaccccaaatgtagacaaggtcatattataaacattaatgctgtcccaaactgccaatgcattgcgtagaactgaggttagcaggttaccattgatttcctctacttatgctttaagaggttggcattggtaagccgctacactttcttggtcaatgaggcagaaacccctttgcaaaactctcaactgatgaaaagattagctagaatgactctaggaactgttttctaaggatctgactcattgattcctttttttggtagggttctctgggccaagttagttcgagtatttatcatttaaattaggatattaccatcaccatcatcatgtacattcataaatcaaagcaagattagagaaggaatatggtggatcacagagcaactcagaaagacgacagcaacaactaggaaatgaaacaccatggttgtatttcaggaaccctacccagcagataggaattaccatagctcctaaaattccatctgggtggttgatggagcctcaattaatctgacaccatagcccatgctcccctcttgctacctgctgaagttagcagggaaaagtcaaagagggtgctgtcagtggggtcaattcttagggatcatagtgaaccaccctccattgcactgactctttcccacaaaatgggctagagatagcagctctccttatgtatttaagaaagaatggtcaaaaaatacaattcacattttattctggtatataccattttgacagtgtttcacaatgtaggtaatatgaatgggagtatttaaacacaatcctgtttaatattcttagccagtacttattaaatgcctaccaagcctggcattgttctagagacctcaaaatacacctttaaaaacatattttattgacagttgtataaatgaagaaaacaagtctcagaaaattaaagtgacttgcacagatacacaagctagaaagtaataaaactgaattttgaacccaggtttgtcagactctaaagtccatgattttctgctccatgtggccaacccagttagaaaggttataaaaaatcttaacagtttttcagcccttctcacacttagctttaggattaaaagtattggtcatgatttgcaaaaaaaaaaaaaaaaaaa

SEQ ID NO: 590 - DNA, 630 bp, Homo sapiens
  misc_feature (26)..(26): n equals a,t,g, or c
  misc_feature (29)..(29): n equals a,t,g, or c
  misc_feature (56)..(56): n equals a,t,g, or c
ccctcccttaaggggaccaaagctgnagntccaccgcggtggcggccgcttagaantagtggacccccgggctgcggaatcggcacgagaaacactgagttcagctgccctgtctagatattctggattactacagcagccttctagcctatggttggaacccatctgatacttttcccattcttgcttagaacaatggtgatatttctctgcttaaaatcctcttgtggctcttttttgcccattaataaaattcaaactccatttatccttaatctcatatacaaaaccttcaagatgtgctccttacctaactctcttttttcccctttatctttcatatttttcattttttttcttacctaaccctgtagccttatctctcttcttggatgatcttttgttctaccaatacccagcttctggaatgctagtgtttgtttactcagtcctccatttcctcttcctggaattctagcctctcttccttcccctaatctagtatactcctactggtccttcagaactcagtttaggttataattctccaaaaaattacaattaggttctctctctggatcccatccctcaaaaaaaaaaaaaaaaaactcgaggggggggccggtaacc

SEQ ID NO: 591 - DNA, 861 bp, Homo sapiens
gaattcggcacgagcctgagtcaacttgatatccaagctttttacttcaattatctggcaagattacatagactgtcaaagtttgtgaaagtttagcaagaaaactgtcttactcacagaaccacaggactaactgactgaaccacactccaccatttgcccctatttccaggcgttatggtcaccctgtagtttctaatctgtatagatgtgtagagcatgcctcttccctcttcctttcccctccctgttttcctttcctcttgccctttcttaatgtctgtytctattggcttcttgatcttggtctttaatgttcatccttaagcttgcttctctcttcagactactgattcagcctcttgcattttctttcaacttgggccaaaaaaacaggcaacattttcttcctccactacctcatcatcatccaatttattcctttagtttatattaccacaactctcctaaacgtcccaagtctattattaagtctaacaacttagcttcgaacctcaatccaagcatctgacaacacactgaaatgtgcaagcaagagtcccwatggccgggtgcagtggctcatgcctgtaatcccagcactttgggaggccaaggtgggatcacctgaggtcgggagttcgggaccagcctggccagtatggtgaagccatgtctmwactaaaaatacaaaattagccggacattgtggtgcacgtctgtcatcccagcaaggcaggcgaatcgcttgaacccgggaggcggaggttgcggtgagccgggatcgtgccattgcactccagcctggtcaacagagcgagactccgcctcattaaaaaaaaaaaaaaaaaaaactcgtag

SEQ ID NO: 592 - DNA, 587 bp, Homo sapiens
  misc_feature (1)..(1): n equals a,t,g, or c
  misc_feature (587)..(587): n equals a,t,g, or c
natttctcacaatgacaaattctcaaatattgctaatagtactgtggattttcctacattggtaaattgaaggaattgctaaatgctgaattcagcaaccagtttgagattgttgaaaataaagattgtttctttttcaatgcaagttcacagatcactggagttctagctacagtttgttctagaccagaggttgcagatatttttgtcctataaagagacacatggttaatatttttggctttgtgagttgtatagttttccgttgtagctgttcagctctgctacatgaaagcaaccatagaccataccttaacaagtggtcacttttgagtaccaataaaactttatttagaaataacagagggctggatttggtcctagtttgctgaacccttttctagatgaaggctcctcttgccaagactggctccctaccttggctgacaaattctcactttgggacttagtcattgttgctgctctctgttattttgcatgtcttttctcatgtttaggtgctgtgtcttaatacttttttcttacatttaatttaacaatcattactgagcgctggtatgtctagn

SEQ ID NO: 593 - DNA, 1370 bp, Homo sapiens
cagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagcttttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgccagcatcaagaggggccatcttttgataggatgacacatgcatgttcaaacatattttaaaagattagggagaaaagaatactgtgaacaaatagaacccaattatgagcaaattcacgaattcgggtatgtactattgtggctggcaaaagccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttttgctaaatgaatgcatgattatcttatacaataaaagtataacacaaaatactgttttaagatagtcgctgggactctccttacccttgaagtgtccccctttccctcctccacatccagtcaaccgcaggttcctcccaggtttactatctgacatgttttagctctcttccttcttttccattcctctacaacttctctagttctggctttcattgtttctcaaccaaaacagtctccccttctctctcctccattcttgcgtccttccaaaacatcctctccaccctgccagagcagctcaccttagtcacagtctgactgcaactgcatgtgcttatcaatcctctcatttctcctcatcacctataacagtgcttttgacgctgcaacttgtgagccatttcgcgggttagaaaataagtttcatgggttgtaaccagtagtttaaaaaaaaaaaaaaaaaa

SEQ ID NO: 594 - DNA, 1397 bp, Homo sapiens
  misc_feature (1383)..(1383): n equals a,t,g, or c
  misc_feature (1396)..(1396): n equals a,t,g, or c
ggtccctaggagttgagcaggaacaggcatctgtggtttacggcgacctggctctccgcrggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccarggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacgggscgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatcttaaaaaaaaaaaaaaaagggcggccgctctagaggatccaagcttacgtangcgtgcatgcgana

SEQ ID NO: 595 - DNA, 477 bp, Homo sapiens
gaattcggcacgaggtgagtatggcttttgtcttccatcttgctcagggtactttggaaccgctatacattgcaggagcttagcttctggttaccatggtttgcttccagagcaacaagcctagtacttcaacatggagacaattatcttttgtttttgttttgttttgtttgttttgtcttggccatgcctttttgagtttacctttttatattttgtccatcattgccatgtgtttggagcagtgggcgttccataacatgaactcactgtaccatcacgaatgggaagtaaggggaaaccttatccatgtggattttactcttccctgattccctaaattgggtttgcaaaatactactgtgcactttcttgatgattcgggcttatctttatgactgtctgtktttgtgtcagactgtaaagaagtataaaagtctttagcttgaaaaaaaaaaaaaaaaaaaaaaaactcga

SEQ ID NO: 596 - DNA, 1930 bp, Homo sapiens
ggcacgagcagaaatgaaaaattacttgagtgggatgagtaggaaaaaaagtggtagtgtcattcaattccagaggaagagatgaatttaatggtgaggttactggcattgggactaatatcagggatgatgtctaatattactcaatcacattcaagtaaaatatcagcctttggtatcttcattggaccagaacagtttctttagatcttcttatttctctttcaagcttcaaccttaaataataggccattgtgtagcagaaaaaactttaaacttagaagtagaaatctataatcaaatcctcagccaacttaaaaacagttgtgtgaccttggataagtcccatagccggactgcattctctaaaccagcagctataacgtttcctacctcattagagtgtggtgtgaatgaaaatgtgaagaatgcctaaaacagagtcaggccttgaatgcattagaaagtttcaggcagccactcattccatcaccctgtctcactctttctagtgacccagggtcacttacctgtttttcttaatacaccccaagtctttctcttgcctctctttgtagaccagaattattcttgtgttcatcaatatggattgagtcaaaaattttcaagatctacctgacttattacttcaaggatccatcatcctctggcttccatttttttgtatttctataggcatggattcaaaggggatatctgactggctcaggctagatccagatgaactcctcctacatttgttgtccatcctggtccaatcagtggcagctaagggagctcagtcacttgtttgaagtttgcccagtcaaggggctgtggaaggaagaggaagttaatctgagacaggattgtgacaggcagaccaataaacatgtctgtttacaatctaaatattcataaaattccaatcccccaaattctcccacatatgtatgctcttgtattcccctgagataggaagggaggcatgctcataaccccattttacagatgggaagaataaagtgccaggaatactggtccctccattagggtcacttaatgagccactggtgaaacaagaaataaatccgaattgagagcttagactgcctggtctcctgttaacaattaagactgcaaaaatttcaaaccatatcgcatgcacaataaatactgcatctgaatcaattgtagagacaaagacagaggcacagggagaagacagatctatccaaggtcactcaagtgaggaaataaaccagcttaaaatagacttctgtctcagcagcattgtgctttcactcctgggcaacttcctgcctatacagcaacattaatgccagcaaggaaggaacctgagggttaaatccttggccccagccccagatagcaatacagaaccccacccccgtaattcagtcaataaatagatgtccctttcatacaagtttcagaaaacacagttaatatacaaccactactcacaaattaaataagttatcttactgtaaaggatataactattttattatctttgcaattaaaatgaaatatgctaaaggtagaagcaatacaaaacagctgctgccagaagtttcaataaaagatcactactgggcacccttataactgtgggaccattaggagatttaaatgtcttcttcactttgcccacggtagggagtgaggctgcactgagaaacatcactggcatgaggtctaattgcctgccctatgattaatgttgccaagtgaattcagaagttgtcacagttctcatcctatggtccaggctcatttataaaatagagcaaagggagcccagtgctttgagaatgccaatgcaaaattataataattacttattacatgatacagttgttaaagtattttctgtgttgttcaaaaaaaaaaaaaaaaaactcga

SEQ ID NO: 597 - DNA, 1044 bp, Homo sapiens
ggattttcagagacaaaggtccaagttaggagacgtaattactcagtgctttgaagggacatccaaggtgctcactcttagccatagccgttggtttcctggatgctgactgtgaagattctaaagtgcttcctagggtgggcggtggtggcaggaggccttggacggagtcaggccagacccagcctcctgtttaataggctgagcccaagcgtccctcagatgcgaatccaacagccttggtgagttgtaagatttcatggaaactttccctgacttctgtctcccccttgctccccattacctgggaaaggcagctttgtgggccatgtgtcccggaagggcctgggctggctgtggcccagtgctcaggaccagccatcttggccctcacagcgccctgcccagttggtgtaatatttgtyttcaagccattgttggagcaggcaggcaaagggggctttctgaggatccaacgtgtgccagccactgggatacaaagacaggcctggttcctagctgtggggctgggaagggtatctgacatcaatggtggcacctggcagaggacacacagacaacagcaggcagcatggacttttatgtttgtagcttgagctggttttaattggaagctctgtgatttacataatcacttacaatctctgtaaataaggaactatttatgaggaattgtaaatttcctctctcccccttcttaccctgtctgtgatcttgtctgtgatgcagtaatgatattccactctaggttcccatgatcagtggtgaaatatagtgattttcacctgtgcttccattctgaagttctggaaagaagtactggatggactgaagtccaggacaacgtyccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtgaaaaaaaaaaaaaaaaaactcgag

SEQ ID NO: 598 - DNA, 1143 bp, Homo sapiens
  misc_feature (1100)..(1100): n equals a,t,g, or c
ggcacgagggctggggtcagcaaatatacagggggccgaggcgtcacgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcagatgagcacccatgggaaggtccgcttccggggacatcgccttcacccaagttctccatgccctcccctgttccgcacggtcatcaccggccgactttgacaatgaccaggagctggagaatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcaaccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtncggggctacgagtcccaacgaggatggcacatacgggcttgtc

SEQ ID NO: 599 - DNA, 791 bp, Homo sapiens
ggcacgagctgcatttgatctcattctttagtccaatgtaagtaagagtaaaacaatgacatttaaggccaccaggctattctcatttttggaaaaatgctggattacattaccagcatattaaatgagaatatcaaggtgtaatatctccctagaaattgtctcaccttcaatactattgacatttttggacctgataattttgttgtgggctctagcctcatgttataggaggtttaccagttttcctgccctaaacttaccggatgtgaatagcacactccactacctacagcagtaaaaactaaaattgtctctaaacattgacaaattgtccctggtagtgaaaatcacccctggttgagaccgtgttgttgaaaataaaacaaaaactttcacatcaataaatatgttaggctgtgtatgttaaggattaacattaagacaatatggagcaagcactacatgaaagcagtgacgattggggaattagtggcacattatcctaatagttaatatagtgactgtaatatctaaatatcatcctatagagtttttcttagattttttcattagtataacaggatgttgtgtatgttacactgtatatactgttattttgagagacaattttgggaattttgccaaggtattttcaattataggtctttaatacattctaagcaagtgggtctcaaaaatgggaattttacaccccacattcttcttcccatccggtggacatttgtcaatgtgcgcaaatatttctgattaaaaaaaaaaaaaaaaaa

SEQ ID NO: 600 - DNA, 2425 bp, Homo sapiens
cgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacggacaaccccgtagaagtcggtcggcaggtcctctccaacccgccgctaccgcgccgctgtgggagagaccccagcaggagcccaagggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaag

SEQ ID NO: 601 - DNA, 1543 bp, Homo sapiens
  misc_feature (76)..(76): n equals a,t,g, or c
cttgactgtgttttattatttcatggcttgtatgagtgtgactgggtgtgtttctttagggttctgattgccagtnattttcatcaataagtcttgcaaagaatgggattgtcattcttcacttcagcacagttctagtcctgcttctctggagtagggttgttgagtaaggttgcttgggttgtgcattgcacaagggcacatggctgtgaggtgtatcctggcggggggctgtctacctgcagtgaggggcaccttttctgttttgctcaaaggcatgtataagccaatgggtgaccttatttcctgtgtcttcaggtgtgtggcagggggcctggggtggggaggtggggcgagcgagcagtgtgtggaaagccttgttgtcacctgaagcacgccaggtccagattgaccaatggttttctcacttcagggccmacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaggtcatgagtttctttttactcgtgttgaataataacaataacaataacaatatggaaaccaccgcaaacttggagaaaagttgtaagcacagtaaagagaagcttccttctgagtcacttgagtggttgccgttctggccctgcaccctctgtgctttgggacggcgtccaacccgcattcatgtcaggagtgagtcgcacgtggctttgtggtcatggcgacttaatctgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttkttttggtatgtacctacattatttaactgg

SEQ ID NO: 602 - DNA, 1174 bp, Homo sapiens
ggaattcggcacgagctggctgcagggtctctggggagagaaggggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggccgccagcccgtgaggtccgtgaggtcctggccgctctgacagccgcggcctccccgggctccagagaaggcccgcgtctaaataaagcgccagcgcaggatgaaagcgaaaaaaaaaaaaaaaaaaaaaa

SEQ ID NO: 603 - DNA, 1766 bp, Homo sapiens
cggcacgaggagcactgaagtattcactacatgaagtatattttgcactgtggacacaaattagaaaaattgcaagtagtggtatattgtaattggcatgcactatatgagcagagtcaatgtgtctccttgtagaatattctctgatgatactcactattatcccctctctgctaagctttgttctgtgtctgaagggcataaagcatggaaactacatttttcagactccattaccagaaggatatggttggatttcagcaatgagtgggctttgcataaaatttggaagacgaaagagaagaaaaacctggctgctgcaggttggaacactggcaacaatagatacggagtttgcaagaagctgctaagcttcctcaggaaaattatttgtttcaatatttctggcatatgggatcatcaattattgttttcagtggttctggctgaaaattggttcaattcttctatctgagaattgttcatttctgtgcttcaggaaactaagaccatcactggcagtttttgttgagggatccttgtgcattcatttttccttaaaacagccttcctaacttttactcccccagcctctatggttgtgtaagtctttaattcttagagttacatttctcttactcagtatatcctagtgcggcttctgttttccagacccaaccctgactgatatagtctccatgtgtttcagatggtgggatagtttggatatttgtccctgcccaaatttcatgttgaactctaatccccagtgctgtaggtggggcccaatgggaggtgttcggatcatgggggcagatccctcacggcttggtgctgtcttcgtgatagtgagttcttgtaagatctggtcattttaaagtgtttggcacttgtaccatttcactgtgtcttgctcctgctttcaccatgtgaagtgcctgctccagcttcacttttcaccatgattgtaaacttcctgaggcctccctagaagccaagcagatgccatcaccagggttcctgtaaagcatgcagaactgttagccaattatacctcttttctttacaaattaaaaacctcttttctttacaaaatggaaagaataaaggtatttctttatagcaatgcaagaacggcctaatacagatggctctgccattagtgagaaaattgagacgctttctctagatggcaaaaaagttgtaaaaataaaaggaaattattaatataccgtctattgtgatcatttactaagttaagcatattattaagaagacaagcataagtttaacacaatttggcaatgaataaaattgaaggagagagagcatatgttggctttgctctgtgaaactcaaatgaaatggtcacctgttctagcagctcatgaaaaattctgcattgtttattatgtgtcaggatcaaccttaaattcagttataaaaagtttgatgattacaaaaaaaagggaagcactaagtaatataggtacagagagggaagagtgtcaaatagaattttcaatctgtgtataaggatacttaagcattttttaaggaaagcagaaagaagcatgagaaagtctacaatgacatctatgtcaatataacaagctggatatttagagaagaaactcttgattaaatactttttatgatatgaacacacacatataatatgacatgactgtgttcatggaacataaagaaattcctctgaccaaagagaactggaaaaaaaaaaaaaaaaactcgagggggggccc

SEQ ID NO: 604 - DNA, 1021 bp, Homo sapiens
  misc_feature (248)..(248): n equals a,t,g, or c
  misc_feature (1004)..(1004): n equals a,t,g, or c
  misc_feature (1014)..(1014): n equals a,t,g, or c
ttcggcagagcccttgcgcgctcttgaatacctgckttctgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagancataaaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagargcacccgtagaakargtggggcaggcagargaacccgacagactcaggctccrgcagcttccctggagcagtcctctccatccytgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgttganaaaaaaaaanaaaaaaa

SEQ ID NO: 605 - DNA, 433 bp, Homo sapiens
  misc_feature (309)..(309): n equals a,t,g, or c
  misc_feature (408)..(408): n equals a,t,g, or c
  misc_feature (418)..(419): n equals a,t,g, or c
ggcacagctcaccttcctaccctccactggaaaccactcctctccatgttgacctcctggattgcctccatcccctcccgctgtggggttctgtgtatctgcttgtgttttggattggttcactgtctggatctgtcaaggaagataaccattttttcaggagctgtgtacatggtgaaaaatatacagttctggttgtaaggaactctcacttgggaatattattatttaaaaacttatacgttgagctcagtgctgtcacagaggtaagaatactgtggaaaggctataaatatttttccccaaagncaggggttggaaacatttttctttcctaggctgttgagactcacagggaaaaaaaaaaaaaaaaatccgggggggggccccgtacccattggcccctangggggggttnnaaaaagggcccgtt

SEQ ID NO: 606 - DNA, 727 bp, Homo sapiens
gctggtatctccagtgtttgggtttagctccaacttacaggttaggaccagcttttctgcaggtgttgaccagcaatttcctgcggcatttacttcttgataacaagagtgagaagatagagacagggcagatagacacttaagagtaaaatgtattaacacaaaggctctggccgcccccctacaaaggaggccatggaaccgatggaactgatggaggaaatgctgggactgtgggtcagtgctgacacacccatggccatacgtttggtcttcttggccttggctgggctggtggatgggaagccagtatggatcaccttgtggatggatgcaaagagaccaaacttggcgggcactggaagtacctggggaagcaggagagactcacactgctgtcatggccccacagcctggagcctcccctgcctcctctgcctcttcagagcccagcagaaagacagagaaagaagcctccttggggttccattacccacactccaaggtggaaatctttcagatggttagatgatgaaggtagtagaaggcaaggatgattgggagtagaaggaagagtgacaggctagcatgagctgtgcagcagcaagattccatatgagcaaagttcagaaagtgrgmmaaaaggaccaagttggatctcctcctaaccctgacctgcatgatatgggtgtgagaagcttcaactgagaaagctgctgagaaagta

SEQ ID NO: 607 - DNA, 2112 bp, Homo sapiens
aaccccagttcaatacgactcactatagggaaagctggtacgcctgcaggtaccggtccggaattcccgggtcgacccacgcgtccgggagttcaaagccatgctgatcgctgtgggcatccacctgctgctgctcatgttcgaagtcctggtctgcgacagggyggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaamcatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtgrtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttargtgtgaagatatgtgkctattgcagatgtccttggaaaactgcataaaacagtatgtgccyggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttytccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgkttcttttttcttttcttttgkttttttgkttgkttgktttgktttgttttgagacagagtttcactctt

SEQ ID NO: 608 - DNA, 1598 bp, Homo sapiens
ggcacgagggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaaaaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttcaaaaaaaaaaaaaaaaaaaaaaaa

SEQ ID NO: 609 - DNA, 1256 bp, Homo sapiens
ggcacgagccgtgtggccaggtaccatccagtctgctggggaccccaggaagaacagaagcagagaaaaggtgaaaatgtcaatttatgtgcgaaggctggctacatccaatcttcctctattgttgtttttggacaacgaccccaagctgctcagcctttggaatcctggatttacaccagcagcaccctatccccaccccttcctcctggttctcaggcctttgtccttggactgagttacatcattgtcttcgctgattctaaaccttgggacttggactgagctaccagcatctcagggcctctagtttgcagatggcctgtcaagggacttagtctccaaaattgcaggagccagtttccctaataaatcccaatgtgatagttcttatcccacaggcccactttagttcagtttagttttgctttgtttttagaaatggggtcttgctctgttgccccagctgtagtgcagtggctcactccagcctcaaactcctgggctctggcgatcctcccaactcagcctcctgagtagctgggattacaggtgcacaccaccatgcccagctactttttaattttttttttttgagacagagtcttgctctttcacccaggctggagtgcagtggcgtaatctcagctcactgtaacctctgcctccctagtggctgggaccgcagatgtgtgccactgcacccagctaattttttgttttcggtagagacagggctttgccgtgttggccgggctggtcttgaactcctggcctcaagtgacccacccacatcgacctcccaaagtgctgggattacaggcgtgagccatctcacctgcctactttttaaattttttgtagagacagggtcttgctatattgcccaggctaatctcgaacacctggcctcaagcgatcttcccatctgggcctctcaaagtgctgggattacaggcaggagccccttaaccaacttcgagaacttgggaaataagatgtggtgggttcttgccaccgtgagccaaacctgggtcagaacttcatgtgtgatctggcccctacatacacccactctgataggatattatgacactttggataacaatgtcgatttggaccttgtgtcccacaggtcttaaaatatttggttattccacttttcccagtgtatagttaccagagcaaatgatagttccctttggagaagtattaagggatcattaacaaatactaacaaaaaaaaaaaaaaaaaa

SEQ ID NO: 610 - DNA, 2801 bp, Homo sapiens
ccacgcgtccgcgagcccggggcgggtggacgcggactcgaacgcagttgcttcgggacccaggaccccctcgggcccgacccgccaggaaagactgaggccgcggcctgccccgcccggctccctgcgccgccgccgcctcccgggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacggccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagcgccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagaggcggtggagaggccctgcccagcgggtctgagtgtgaagtgccactcatgggcttccaaggcctggcctcagtcaccccttcacgcaaagccctacatctaagccagagagagacagggcagctgggccgggtttcagccagtgagatgccagccccttcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggcctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgctttttttaaatatatatatatttataagagatcctttcccatttattctgggaagatgtttttcaaactcagagacaaggactttggtttttgtaagacaaacgatgatatgaaggccttttgtaagaaaaaaaaaaaaaaaaaaaaaaaaaaaa

SEQ ID NO: 611 - DNA, 1407 bp, Homo sapiens
  misc_feature (353)..(353): n equals a,t,g, or c
gcttaagatgaaaagttccttttcttgtgttaatggatggcacaactggcataaaaggtcattaaatgctaatagacccacttgaggtatgctcgcttaatggaggattagagcaaaacagacttaaaagaccaacatgccagttgtgccatcccttaagatgaaaagttccttttcttgtgttaatgtacaaagcttttcttttggcactgacaactgtgttctacctgggaattttgaatagccattttcatggctgtgtgttgtgtaacacaaatgtttttaaatggtattctcacccagtaggccagctctccaaacgttgcttagatgcttcaaaattagcatatttnaagtttaccagtataaaataccaatgcaactactctacatagccaaatgtttgtaaatcacgtcttattttcctgakgtttttcactccaccaaatcttacaaatsrttgaaagaaatatattctaacagtacgcactgaatagtgaaaataattagacattttaagaaccagagccatagaattattttaaattagtagaaaagaggagctatttccgaatctatagaataaagtaccacctaaaactgaattttatcatataascaagtaatacctattagtcatacctaaatttttcagcacttcattcaattaaaatmcatgaattttaaatattttacatgatgtgaataggcatgataatacttttagtataaaatctaaactttttccatttatcagaaatgataaaatccagttaccacatatcacgtttataaaatccttaattaaatgagtaacttctaaaatataacaatactaaatatcacactgcgatggaggtcccaaatatgtggtctatcaccactgaattcatgtaatagataagaaaaaaattagaggtggatgtcttgttttgtgtcatgaattactaaaatctcttagtagttgtggtatatttttgagtaaaattaccatttccagatttgagtttgaagggcttttatagtkgtattttcctcctcactgttaataatcataatcctttttcagtattttagtggcctgaacaactggtttatctacaatctcaaatcctaagtgtataattatgtgcatgttcaatacctcatataatacttgctcaacagtatagtggtaccatggcattaagatggtgtttttgttctacatatttttcaatatttattctttctatgttgaaattatatcaggctttaccggtttttttagttgtttaaataagtaatattttcaaaagaataaaataaccaatgatatctcttggaataatctgtaaaacgtagttataaaattctattttctacttagaaaaaaaaaaaaaaaaaaaaaaaaaaaaaagggcggcc

SEQ ID NO: 612 - DNA, 1097 bp, Homo sapiens
ccacgcgtccgcccacgcgtccggaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcaaaaaaaaaaaaaaaa

SEQ ID NO: 613 - DNA, 3466 bp, Homo sapiens
  misc_feature (3462)..(3462): n equals a,t,g, or c
  misc_feature (3466)..(3466): n equals a,t,g, or c
acatgaacgaggttgcaagttagatgttaagtagatcctctccctgtgttttcacctgggaatgctgggttggtagtaatcctccccagatgtggaggactgaagaggggskggccttggggggggtgtggttctggtctgctcagcgcatggactgttccctgtgtgtctgtgcgtgcctgcaattgggggtggtgtccaggggctcagcaaggcatgtacacctgggctggggtgtgtcagacgctgtcagtgacaagcaccttccctcagagcccggttcctggagaatgtggcggcagcagaaacagagaagcaggttgcgctggcccagggccgggcagagacacttgccggggccatgcccaatgaggcgggtggacacccaggtgagtaggtgggtgagcaggcagagcctgcctgttgytttgttgccccacagggggcatggcaytgacagctccttccctttctttagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgagctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcaraggtgaaggacacggtgcgtcgacagtcactgctacaccatctctgctccctagtgctccagacccggcctgagtcctctgacctctattcagaaatccctgccctgacccgctgtgccaaggttagcacctgccagaatcaaccaaggccggacaaggcatgaggagcgctgcttcctgggcctggctcctcccccttctccccatttgggctgctgtgccagggcttgctccagccacctgggtgtgagctatgccctctgccagaaatgctctttcctctattggcctggccacacctactcagtctttgggtctgtttaactgccacttcccccagtaaaccttctgctccccattcacatcagatggacttgtgtctcttgcactagtctatgagatttggatgtctgtgtccttagggcccaagctggccactctggcccagaagcagcctcgggccatgtyttgtytacagggtgtggggggacagtatgtgcacccccttgctttctcaggtggactttgaacagctgactgagaacctggggcagctggagcgccggagccgggcagccgaggagagcctkcggagcttggccaagcatgagctggccccagccytgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgaggtgggtgcccttccaggtcttagtcttgactgccacctccttggtttccttcgctcctcccagctcacccttcttctttctccagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtcttgtaagtaaccccccacaatcccactgcccacctgaaccccatcaaccccctccaaccctgctctgtccctgcagtgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagngggn

SEQ ID NO: 614 - DNA, 1238 bp, Homo sapiens
ccacgcgtccgcccacgcgtccgcccacgcgtccggctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatactaaaaaaaaaaaaaaa

SEQ ID NO: 615 - DNA, 1926 bp, Homo sapiens
gaattccccgggctaaaagcttctaaccactagcagtggttgtaaatttggatttcaaagaacagactcatcgtgctgacactttctgtctggtaggaaaggatatggcttctcccagtcttgggcttctgagcagacacctaggttcctggaaggttctgggctgacagggcaggtgttagtatggccacagtggggctgagttggaaaaaagagctggtgatcttgcttgtggggcctggagctgcagccctccagcccactcatacttgctgttccctacctagcctcagctctcttttcccccttaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgcgggggtttgttgtgatggccactcggtgacctggcggtccctacgcaatagcagctgcctgtggggaagaggggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccggcaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaaaaaaaaaaaaaaaaaaaaaactcgagggggggccc

SEQ ID NO: 616 - DNA, 1773 bp, Homo sapiens
cccggggttggcatcagcttgggcaggtgtgcgggctcattggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaaaaaaaaaaaaaaaaaaaaaaaaaaaaaaaaa

SEQ ID NO: 617 - DNA, 1481 bp, Homo sapiens
gcgcactggatggctggggccgcccggatcgccgccgccgccgccgcacgtacgtggcatgcctggatgtccctgccctggctgtggcatggcgggcccaaggctcctcttcctcrctgcccttgccctggagctcttgggaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcrctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacataaaaaaaaaaaaaaaaaaactcga

SEQ ID NO: 618 - DNA, 1147 bp, Homo sapiens
ggcacgagctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggcttttaccaagctcaagtcaacctgagaacatcccagatctctaccatgcagcagtacaatctatgtgtctaccgatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccaccaaaaaaaaaaaaaaaaa

SEQ ID NO: 619 - DNA, 1341 bp, Homo sapiens
caggaattcggcacgagagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacataaaaaaaaaaaaaaaaaa

SEQ ID NO: 620 - DNA, 912 bp, Homo sapiens
tcgacccacgcgtccggtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccakccgcggcagggctcgctggggtctggcctacacgctgctgcacaacccaaccctgcaggtcttccgcaagacggccctgttgggtgccaatggtgcccagccctgarggcagggaakgtcaacccacctgcccatctgtgctgaggcatgttcctgcctaccatcctcctccctccccggctctcctcccagcatcacaccagccatgcagccagcaggtcctccggatcacygtggttkggtggaggtctgtctgcactgggagcctcargarggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccytcagcgccacggacctytytggggagtggccggaaagctcccsggcctytggcctgcagggcagcccaagtcatgactcagaccaggtcccacactgagctgcccacactcgagagccagatatttttgtagtttttatkcctttggctattatgaaagaggttagtgtgttccctgcaataaacttgttcctgag

SEQ ID NO: 621 - DNA, 563 bp, Homo sapiens
ggcacgagtacagctttgccattcatagatacatacccttcatcctgtggcccatttctgacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcctaaaaaaaaaaaaaaaaaaaaaaaaaaaaaaaaaaaaaaaaaaaaaaaa

SEQ ID NO: 622 - DNA, 801 bp, Homo sapiens
ggcacgagggaaggtgaggggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgaaaacaaaaaaaaaaaaaaaaaa

SEQ ID NO: 623 - DNA, 734 bp, Homo sapiens
gctcgtgccgctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaacaaaaaaaaaaaaaaaaaactcgag

SEQ ID NO: 624 - DNA, 413 bp, Homo sapiens
  misc_feature (407)..(409): n equals a,t,g, or c
gaattcggcacgagtgcagcttcattttgggctgccttagccatgaagctccttttgctgactttgactgtgctgctgctcttatcccagctgactccaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactccatcaataaacacctctggctgaaaaaaaaaaaaaaraaaaaaaararaaaaaaaagaaaaaaaactcaagggggggcccggtacccattcgccctatgtnnntcgt

SEQ ID NO: 625 - DNA, 1549 bp, Homo sapiens
  misc_feature (873)..(873): n equals a,t,g, or c
  misc_feature (895)..(895): n equals a,t,g, or c
ggcacgagctaaggcaaagatgagcagagccatggccctcttctttgttctctgctggatccaaggctattcccaacagaagagcttgaacaatgctgcatttgcatcaggttcaaatgagcgagaggaacatttggctaaaatatttgatgaaattctactgcaggtgtttccaaagtttccgtatgacccatcatttaacgaagcaacagcagtcagatccattacaaagacagacatgagaaaaggaaccagcattgcttggaattctcctaaaccagaatatttccttggcagtgtggacaaaattcctgataaagatcacctttcagaggagaagaattttaaagaatcctgtctgttcgacagggatttaagagagcagttaactactatagataaagaaacacttcaaggagcagctaaaccagatgctcactttaggactatgccctgcgggcagcttctgcacttcctgcagaggaacaccatcatcgccaccgtctcaggggtggccatcctcatggccatcgtgctgttgctgcttgggttggcctcatacatcaggaagaaacagccatcatctcctctggcaaacacgacatataatatttttataatggatggaaagacatggtggcacaattctgaagaaaaaaatttcacaaaacttgcaaaaaaacagaaacagttgaagagcagctcctgtgtctaagccaggtcgtggggccgtcaaaccaggacttgaaaccacaatgcgaggacattctccatctgcgcaccacagggaggcaattccatttctgcccgggaggtgtattctacaaaaacgtttgtttcccatcccaatttgaatggaccaagaaaaactgntttaccataggacacttgtggnaatatggcaccgatggctggcgtcggtgaacccgacagactatggatttatcatttaataaagctttgattcattttttcagtcaaaaaaaaaaaaacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaaaaaaaaaaaaaaaaa

SEQ ID NO: 626 - DNA, 839 bp, Homo sapiens
  misc_feature (1)..(1): n equals a,t,g, or c
ngaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaagggagccccacccctctccatgaatgccttcccggctccatctcctacttgcaccccagaaccccttggctctgtctgcctccccagcacctcagtttctctaccttctcaccctccctggcagcctgcaatgagtcctgtgccaggaaccggcggacctccctgtgggctgtgagtctcagcagtgctctactcctggccatagctggagatgtttcttttactggcaaaggaagaaggaggcagtaaaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccct

SEQ ID NO: 627 - DNA, 1306 bp, Homo sapiens
gaagctcgaaattaaccctcactaaagggaacaaaagctggagctccaccgcggtgggcgggccgctctagaactagtggatcccccgggctgcaggaattcggcasrrggcaagctgagatcttcaacgcttcctacaagaagtacctagatagggagtgggaggaagagccactcaggaccaagactctgccagcagctctccttgccagggagtctacatggctctgaactcgtgtgtctttctttcccagtacggccaccttctatttccttcttcctagctgcctatttgcaatgccaccggaagtcaagggcccctcaggcaaggagaatagcacttcataaagagaaggatgatgaccccgagggtgtgtggccctgtgctgcgcccattgcagtctctcagctcagctgctcctcctcctacctggtgctggcctgcgaggaatggtgtgctcacgctgtgggacctggccaaaggattccctcttggggtcgctgctcttcctcaaggatgtttctgccaaagcattcacttcctaaaatatttctcggtccacaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagatgtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgcttccaggacactgaggccaagagaaatgtaacagarccacagctccacaggcctgcactcggagtctggggcctctgcagaaccagcaaggggaaaagtataatctgggggaccttcaaccactaagcctcttgtcagaaccctcaggcagggcagatgtgtcaccaaataaaac

SEQ ID NO: 628 - DNA, 754 bp, Homo sapiens
  misc_feature (1)..(1): n equals a,t,g, or c
natcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaaaaatccatttctgaagccaacggggagagcacctcagcagacagcctttaatccattcagcttaggttttcttcttctgagaatcttttaatgtcatttatatacaaaagaaattctcaaatgtt

SEQ ID NO: 629 - DNA, 1022 bp, Homo sapiens
cgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagwgtaccaagaggctattttagcctgcaaaaccccaaagaagactgtttsctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactc

SEQ ID NO: 630 - DNA, 1028 bp, Homo sapiens
gcatgatcctgtggaacacagtttgggatcatagatgtgaattaagacaccaccgagatacgggctgtgaggttcataccgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccaytgccccagtctcccgtgaccccagaaaccaggtcactggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcacggcacgtag

SEQ ID NO: 631 - DNA, 450 bp, Homo sapiens
tttttttactcgaaaaaatgtttaatagaatttaaaattttaacttcagggaatttggaagttcaatcattctcaaagaggctgtaaggatgattaaaatcctgaaggaagccattgaagaaacttccttctgctctttctggaggatctcttttcaattatctattcatcatatatttcttatcttctgtgcacaattgacaactcttctttacagcacattcctcttyattcccatctcttggtttctgattgttcctggggctgtggataaaaccattctctgagaagctgataagcaattggatgagaaagarggagargaaaactggcaggargatctggscccatgcccgcagccagcacatctctcttcagacctggtgaccccagccactgggaacctggcaggcaccagctacagtgttggacactgctcgtgccgaattc

SEQ ID NO: 632 - DNA, 978 bp, Homo sapiens
ggcacgagcggtttccgcggtggccatgactgcggccgtgttcttcggctgcgccttcattgccttcgggcctgcgctcgccctttatgtcttcaccatcgccatcgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcaaaaaaaaaaaaaaaaaaaaaaaaaaaaaaaaaaaaaaaaaaaaaaaaaaaaaaaa

SEQ ID NO: 633 - DNA, 1075 bp, Homo sapiens
  misc_feature (79)..(79): n equals a,t,g, or c
  misc_feature (604)..(604): n equals a,t,g, or c
  misc_feature (656)..(656): n equals a,t,g, or c
gtgtcgcagctctcttcgacgtacctgtcctcaggagccgcggcggcgactgcgcctcggacggccgtcggggccgagnaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatmcaagtgtgttgtacgggtaraagaatgccgtggaccaacagattgtggctggggtaaaccaatttcagaaagtcttgaaagtgttagattggcatgtattcacacatctcccttaatcgtttcaatatatgtggaacttytaagacagaccacaatccattatacttgtaaatgattcagcaatcctagaagtacgcaaggaangtcaccccttgctttcgagtgtgacacactggataataatgaaatagtagcnactattaaattcacagtctatacgagcagtgaattgcagatgagaagatcaagcctaccagccactgatgcagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaaaaaaaaaaaaaaaaaaaaaactcga

SEQ ID NO: 634 - DNA, 752 bp, Homo sapiens
gatcaaatcctgaagtggtacatgtcactactgttcatagtctctttgctggaacttggtcctatggccctactggcagagaggaaggctatgaaacccagtctaggcctgcgcctagaagaagaagaagaagaaacaccttttgaagaacagagagcagtctctgtcataccaggrgtacctgtcacatacttgtagaacaaaaataagtaacattttaattattgaaacaatgtaacaactttaaacacagtttcataactaggagtgaatcacccataatctcatacccggaacaaaatatctgttagtatgatgcacctttacatagctgtaatcttaaagggcatgtacttccttctttgctttcctttttttttttcttcatcctttccctctctccctctctccctctctccctttctcccttccttctttcttttcttcctttctttctgattttctaacttccttctttaaacattccttgatcgtctgtgggtctggacagcaacatggagatcaattaggcgcagcattttaaatttgccctcaagaagttccactagtgtaagagtaggcaagtaaccaattattacaatagtgggacaagcgctgtgatagaaataaatacagagtactgtggcagtccttacccagaaaaagatatctagggtagatggtatctgaactgagaattaaagaataaatagaagatagcatggcaaaaaaaaaaaaaaaaaaactcgtag

SEQ ID NO: 635 - DNA, 1748 bp, Homo sapiens
ggcacgagtaaagacaaaataaattcttctgtccacttatttacctaacatacacttgcttccttggaagtcataggcatccacatatcttcagccacaacttggtatttctaatataattcttatttttgaactcctaaactttctggtagaaatcttcagttgaaaatatcctggcaagtaaaattagaaactcccagaaatgtacttatttctattatgttgttttatttctgaacattgtgcccaacattcttttccacatacttgcccaaattggaaaactagggttctaagtttccccctccatccatgcccacatttaattcaccctaataatacctgacatctttcaagttcattttctactatctatccccacgcaggccatatctgggttgaagcttcattatctctatagattaaaaacaaaaacaaaatgcatacaagcaaaacaaataacatacaaacaaaacccacctaactcatctttatgtagtcagtcctccctcaatagtttggccaaacttcctaaaccgaaatctgattgtgactatccccttctaaatgtatttaatcagcataccccttcaataaatccattaaccgttcttgttatccaagacagtttgtcatctgtcttggataacaagttgcagactccatccaatgccattttcccctagaaatatagataatggcactataggaacaatgatctccacatgcctcatgcattggtaatttttttaacctttgctagaaatgttctgctccactctactcatccaccacccattctactccaccttacactacctcttttcccatttagatcttccattctatatctccttgcatgaaattgtccatacctgcttagtactcatctcattattttgtcattgtgcgcatatctgttcatatgatttcttatggaagttattaagtattttgatttctgtttcagtcagatttccaacagagaagtagaaccagtagaaaatatatcttaagatacttattggagggaattaacttacatggttgtgggaaccggcatagccgacctaaaatttatatggctgactatcaaaaaagacaggctggaactcttaggcacaggcagaagttgcagttcacaggtgaaatttgttctttatcctggaagcctgggctctgctctttagatttagcagctgactgaatcaagtccacctagattacctaggataatcttgtttacgattatgattatcactaccagttatcaactgattttgaacttcattcacatctacaaaataccttcataggaacatctagatcagtgttggattaaataactatcagctgtagcctagccatgttgacccatcaaaagaccatcacaattgctgatataactttaataaaatttgcaacattttcagatggaagaattgagaaaagggaagcgggctgacttttcattttagaatttattatgcattaacttaaagtaagtaataattatgtaggtgatcattttgatattttaacctacttaatttagaaaatcatttaaaatcatttttgttaagactacaaaatgattttgggtaaaaaaaaattttaccaaatatcaagatcacaataatcacttaaaatagttacatatgtaactaacctgcacaatgtgtacatgtaccctaaaacttaaagtataataaaaaaaaaaaaaaaaaaaaaaaaaaaaaaaaaaaaaa

SEQ ID NO: 636 - DNA, 1094 bp, Homo sapiens
  misc_feature (1)..(1): n equals a,t,g, or c
nacccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagcca

SEQ ID NO: 637 - DNA, 531 bp, Homo sapiens
gttctaattcactgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcacagagacctgctgtcaacccccctcattaaaattcatgtgcctgctaaaaaaaaaaaaaaaaaaaaaaaaaaamaaaaaaaaaaaaaamamaawaamwaaamawaaaaaaaaaaactcgag

SEQ ID NO: 638 - DNA, 808 bp, Homo sapiens
tgcaggaattcggcacgagattacaacacatcagaacaaaatgttatggactaccatggagcagaaatcgtgagccttcgtttgctgtcactagtaaaagaagaatttctttttctcagccccaacctagattcacatggactgaaatgtgcatcttctcctcatgggctggttatggttggagttgctgggactgtccatcgaggaaacacttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttaaaaaaaaaaaaaaaaaaaaaaaaaaaaaaaaaaaaaaaaaaaaaaaaaaaaaaaaac

SEQ ID NO: 639 - DNA, 1898 bp, Homo sapiens
  misc_feature (1398)..(1398): n equals a,t,g, or c
  misc_feature (1428)..(1428): n equals a,t,g, or c
ggcacgaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatctaattgataagaacctccaataaatatgttctaatatttttcaggaagaataaagaatagagagagacatataaatgtgcaagaggcaaaactttgagcatagtgtaaaatttaacatattaactctcacgaaaggcaaaatccttttatgtgcagatactttaattcatgtagattttcctattaatcagtaaagttgaatcctaacaataatgccatgtgacaacctatttagattattccagaattaaattcaatttattttctagagctcaagtaaccactactttaactgaaatttgatgttaggtttcccttgttcctccgaatggttcttccacactcaaaataattgaatggttgagttggttaagcaaagagttatcctgccacctaagagcattcattaaatgattatttattaccacctactttatactatcttcctttctttaaacatggagtctaaatatgtaatatatcaaaaaatacttctgatttggtagatttcttatatcaagggtgagaattgaactgtgccattggctattcaatagcttattgaatgtatgttttggatgccacatcctcctggaagcaanttttgccaagatactgtttattattatttntaattaaagtgatactattccattttcaattaaatgctgtctgtagctgttaacttgtcagataaagaatttgaccctgtcatagtgaacatctgtctttaccagttaacatgcagctaagaggtaatacttctatgggacttcctaagggtcagaatatggtacaagtacattgcgataaattatttaatcttcttaaagagtgaaatatatcatgattatcccaattttacagataagcaaacagaggttaaatcatttgcctgagtcacataacttgttggtgttggttcaagatttaaaatagggcaatctgcctttagatctgtctctatactctctctttgtatattagccactatactctactgcttggaatcatcttaagttgctgaactttagttctctagaaaacaattgctattcaagcagttatacaactctcaataaaacttaaagttgaaaaaaaa

SEQ ID NO: 640 - DNA, 813 bp, Homo sapiens
  misc_feature (16)..(16): n equals a,t,g, or c
gaatccccccgggctncaaggaatttcggcaacgagggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccatctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcaggaccaaaaaaaaaaaaaaaaaaaactcgag

SEQ ID NO: 641 - DNA, 1713 bp, Homo sapiens
ggcacgagcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaagcccaggaaacagaatactcatttctcagacaaggatggagatgagcaactacatgcaatagatgccagcgtttctaaaccaccttagtagacagtttctccccgaaagccaggcgtagaggaaaacattcatgatgatcccatcgactgtttggattgatccgtgctaagagaaacctattaactagctggaccatgatctgttcaatgattggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcaaaaaaaaaaaaaaaaaa

SEQ ID NO: 642 - DNA, 703 bp, Homo sapiens
gaattcggcacgagtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcttgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaa

SEQ ID NO: 643 - DNA, 848 bp, Homo sapiens
ggcacgagcactactgtaagagctggtcagtgaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactccttgagaattgctccactgccctccagcctgggcaacagagtgagacacttcatctcaaaaaaaaaaaaaaaaaaaaaa

SEQ ID NO: 644 - DNA, 1818 bp, Homo sapiens
ggcacgagtctcaaacatgcacgtgtacctttaggatgaatttctgcaattggatgtgccaaggccagagcgtgtgcatttgtggctttggttgacatcaccaagtcgcccttcctggggcctgtgctggtgtactctgaggcgcgattgtgtgaaaggtgggctaaggtgcctgttcgaccacatcctcactggtagactgggtcaccacagttttggaaaggtgagaaatggtatctaaacatagtttgaatttgcatttcttttactggaagggaggctgcgcgtgtttcacatcagagccacgtgtgtttgtggttgttgaactttctctcttggattgctaggagtgctttatgtattagggaagcagacttccctaatgcgtgataacgcatgcagatactgtttccaagtttttgttatttgtcttttaaatttgtttttgcatttgtcttttcactttgatttttgccaggctggagttttgatgtttatgtggtcataggtgtgaatattttcttttgtggcttctggattttgagacacagtggctatagaaccactatagccaaaagttatgtttgcttttggtttcatatactttgctttggtcctgtcttcttgactttatttaaaatagtaagatattcttactacatttttccattgcccatagctggaaggagattgcaattatcaccaaagatgaaaaactaaggcatgttctcagcagaggcagattagactttaagttagaggcttgtccttggtgcagaggcctgtgagcgacccggccccacttgccctgcacaccatggcgtggattgtgggcagtcacagggaagatctctggctttgctgggagctggggtacggttcttagagtgccattctagagtggcttcgcgtactggtaatgaacgcccatcaagtggccttgggaattcatgagccggatgatgatgacttcgccggtgaaaagcaaatcccaaataggttgttttctgtgcattccagtcccaatttctcttccaagtaattattagatgtgccaagcctgttacgtttattacttacagaattgtttttgtctgtgtgagtttactgaggacttaggggttggtatgtgaggaggggagccccccttctcctgtgggcactctagcactcttaataatcagtattaaacatgttgaaggccataaaggaaataaccttctcttaaaaacaagttagagtcagtcataaaactgtttgcctagaccttgatcacttaaaataagatcttagatgtgatgtgtctttgtggagtatttcctgtggctcgggaggtgtgcatgagagtggggtctgagggacagtgaggggtgaaggaaaggtgggagagagggccttcagtgactgtaccaaagactcacagacactgggtgtcttggtgatgggtgcacatagcccttcttttgtgactgaagctgtgtggccttcatcccacagggtctgccctctccagataattctgtcactgaacttcaaactgtcaatggaacgatagcgcagtctcttaacaatgcttcaggacagataatagagctgtgcgggcagcctcggtgacagtgttgggaatctgcagaatggctttgtccacttctttcctttcagaggagacattgagcctcggcatggtgtctcacgccaggaatcccagcatgttgggaggctgaggttgggggatcggattgcttgaggctaggagcttgaggtcagcctgcgcaacatagtgagacccctgtctctaccaaaaaaaaaaaaaaaaaa

SEQ ID NO: 645 - DNA, 1632 bp, Homo sapiens
cccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaawrkgctgaggcccctgtgtgatattgaaaaaaaaaaaaaaaaaaaaaaaaaaaaaaaactcgag

SEQ ID NO: 646 - DNA, 1061 bp, Homo sapiens
aattcggcacgagagaaggaaatacatcaaaatgcccacattggttatctgtagaggatagaatgaaagatggctttattctcttgtttgctcttattaaagcaatcagatggtgcttctcctgtactcagagccctggctgcttcctgcctggcctctcctgcgggctgctgtggaaccagaaaagccttaaacggaaatgtgggagagaaggttggattcactttcatgtctttccagggttgtgacccctcaagtcctggttgcctttgctgttctctattaccttcaaacagccagctcgtctttatttcttttttagttttgtcggggttggcttgatagatgttagtccatcatagccagatgtgtctagccttgtcttttgaatgcaagatttaggatgtgggtacttagctgttagtggacatcagagtcactagtcaggatgaaagagttcttggctttaactcccagaaattctggtaacgtcatgtatagtgacggccgcatgtctaacaggtggccaggtaagtcttttggggtggtctgtgaatcacagtttgggagacattgacttttagggagtttgttctgaattcactagataatagagatataatacagagctttgaaagctggtgtcttgatgacagagccgtggcaatggggagggttgaggaggtggctgttgggcctgtctcctggtgagagttgaaagggcctgaactcaagcagaggcctcagaaccgaaaggtggtggaaggatgcagcaagaggcgccacacaggagtactctgcgccctggcagggtctgaatacacgtgggagtggtgagagggagaactttaagtccaggttttgtgcctcagtgacttagtgtggccatatcattagaaatgtgttgaggccgggcacagtggctcatgtctgtaatcccagcactttgagaggctgaggcaggaggatggcttgaggccaggagtttaaaaccagcctggacaacatagtgagagcctgtctctacaaaaaaaaaaaaaaaaaactcgagggggggcccg

SEQ ID NO: 647 - DNA, 1650 bp, Homo sapiens
ggaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcaaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtytactgggagatgcctgaagggaacagcactgtytacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgmctgagaatggagaaggagaagctacaaagtgggsatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctytgtgttgtgtgcgtggcagcctccaggaataaacattcttgttgtcctttgtaaaatggtgtgaatgctccaatggggccagtttgagggagaaaaggacccaagagacctgcttctgccccagcccttaccttcatccaagggtaccaaccacactgcga

SEQ ID NO: 648 - DNA, 2762 bp, Homo sapiens
  misc_feature (2711)..(2711): n equals a,t,g, or c
  misc_feature (2730)..(2730): n equals a,t,g, or c
  misc_feature (2752)..(2752): n equals a,t,g, or c
ccacgcgtccgcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggttggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaaaaaaaaaaaaaaaaaaaaaaaaaaaaaaaaaaaaaaaaaaaaaanaaaaaaaaaaaaaaaaaanaaaaaaaaaaaaaaaaaaaaanaaaaaaaaat

SEQ ID NO: 649 - DNA, 1216 bp, Homo sapiens
  misc_feature (1028)..(1028): n equals a,t,g, or c
  misc_feature (1070)..(1070): n equals a,t,g, or c
  misc_feature (1087)..(1087): n equals a,t,g, or c
  misc_feature (1090)..(1090): n equals a,t,g, or c
  misc_feature (1157)..(1157): n equals a,t,g, or c
  misc_feature (1193)..(1193): n equals a,t,g, or c
gagcargaagccagtctgcaagccaggaagatagtcctcaccagaacgcaaccatgctggcgcctggtcttggacttccagcctccagaactgtgagaaacacggggatcaccatccttcaagacctgatggccggtgtctggaacaccattgctttatggtttttgagtgtttttggagtcatttcagcccccacgactgggaccagtccaaccagctgcaggtgcgtggggccgaggcctccaggctgtgggccagccggctgacggatgactccatgaggctcttgcaggacaaggaccagctgacgcaccasatgcaggagggcacctgccggaacctgggccagaggctgtcggacattggcttctggaagtcagagctgagctatgagctggacaggcttctgactgagaaccagaacttggagacggtcaagaggcggmtggagtgcgcggccaatgaggtgaactgcccattgcaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactcttcagaacatgcgggccaaytccatccrgytgcgggaggaggyggagcacctctttgagaccttgtcggatcagatgtggaggcakttcacagacaccaacctggccttcaacgcccgcatctctgaggtgacggatgtgaaagaataagctgcagacccactggcgaacatgggacctactggctagctnacctatgcttcagctttgacatctgctggccttcttcttggnccagctcctttcatctncanctttggggcccgacagacgctgaagagaactttcaggccgagaacaccatcatgctgctggaaaggnccatcatgggcaaggagggccgttgaagtgggccanacaagctggatgccggacccgct

SEQ ID NO: 650 - DNA, 818 bp, Homo sapiens
aaaacttgagtatgttgagggaaggaatatatatatatctgggagagaatggatacgttttgtttttctgaaatggaattagaaagatgttcagttgtcttgtgcattcttgcaaaccttgcagttttgagagccctgtttctgccttgtatcattttccactgtgtatckgattctaggagcgtgaacagggagacaaaggtgaagtttgtgcacacctctgtccatggggtgggtcatagctttgtgcagtcmgctttcaaggcttttgmccttgttccycctgaggctgttcctgaacagaaagatccggatcctgagtttccaacagtgaaatacccgaatcccgaagaggggaaaggtgtcttggtaacctaatttttttttaaattatgaaatctgcttttatattcaaaactattactgtcaagtaaaatacatttttatgtgttttcattgtgctgaagaaaaactaatttcagcatggaaatatgtatgtttggctgggtgcagcgtctcatgtctgtaatcccagcactttgggagaccaaggcaggcagatcacttgaggtcaggtgttcgagaacagcctggccaacatggcaaaaccctgtctctactaaaaatacaaaaattagctgggtgtggtggtacatgcctgtaatcccagccacttgggaggctgaggcactagaattgtttgaacctgagagatggaggttgcagtgagctgagattgcaccactgcactccagcctgggtgacagggtgacagagcgagactctgtctcaaaaaaaaaaaaaaaaaaaaactcgag

SEQ ID NO: 651 - DNA, 712 bp, Homo sapiens
  misc_feature (565)..(565): n equals a,t,g, or c
gaattcggcacgagctggacaggaccggagaggaccccgcgtaaccgcggaacagacactcccggcagcggccgccgccgcggcactgctacgggacgagccggagcgcttggccatggcggcccgatccgcactggcgctgctgctgctgctgccagtcctgctcctgccggtgcagagycgctcagagcccgagaccaccgcgcccacccctaccccaatcccgggtggcaactcgtcaktgagcaggcccctgcccagcatcgagctccacgcctgcggcccataccccaaaccaggcctgctcatcctgctggccccgctggccctgtggcccattctcctgtagggacgcccagccagccacctctaagtcgccgctgggactggcctgccccattgagcaacagagacgcttgacagccgcccgcctccattccttgacttcacccagaaatgggtccagaaaactgaatcccaccagcactggtttggagcaaccggacaccgaggtttcacctccagggrttccatggaagagcctcaatggagatgccacatcctnactgagttaaagatgggctgaggaacttgggtacccacaagtytgccttgggratcaaaagaaaatatttacctttagtttggttcattaaatgcatgaagtcaaaatatgaaaaaaaaaaaaaaaaaaaaaaaaaaaaaaactcga

SEQ ID NO: 652 - DNA, 2248 bp, Homo sapiens
acgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctga

SEQ ID NO: 653 - DNA, 534 bp, Homo sapiens
agcccttcgtggccggctttgccgtcatcaccgcggcccaggacgtgtggatgctgctggggggccgcctcctcaccggcctggcctgcggtgttgcctccctagtggccccggtgagtgtcccgtctctcgagtgtcctgtctcgcggcctgagaccgagggggagtgggacaaaccgctccccaggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtgaagtcctttgcccaggcgaggtccacagctagtcagaggggaagcagttgcaggaacccagggttgtcccacttagccgtgcccytcttttgctctgcaaactgcggatgatccacaggagcccactccctacattttggttttcatccctggcttcggggtcaatgactgcaattagcaggaagttcctgtcct

SEQ ID NO: 654 - DNA, 1032 bp, Homo sapiens
tgcaggaattcggcacgaggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggtaagcaaggctccgtccaggctgaggggcgtgccggtggcagctcggggccctggaggctgaggggagccctggcggctcttgtacgtgtttcaggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttaaaaaaaaaaaaaaaaaaac

SEQ ID NO: 655 - DNA, 1074 bp, Homo sapiens
gctttcctgtgtcccagcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgarcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaa

SEQ ID NO: 656 - DNA, 978 bp, Homo sapiens
gctcacaagataatatctcttgcctttttcctctcggagtgttcctgcggtttgtgatctctcttagctctggtagcctgttcaggccttaaggtatctgttcggtattatgtggtcaagtagctgggaccacaggatcacaacaccacgtctggctaatttttttttttttttttttttttttttttttgtagagatggggtttcgctatgttggccaggctggtctcaaactcctggcctcaagcaatcttccagccttggcctcccaaagtgctgggattacaggtgtgagccaccacktctggcttggagggcttattaaaacmccgattcttagcctcacccccagagtttctggttagtaggtcttggcagggctggagaattkgaatttccacaccttccttggtgatgtgttgttggtagttcagggagtacatgtgagaggaaccgtttagatagkaaaaactgcaaacctgaagaagaatagaagaatccttattctgkgctctcttagatttagtttcctcatctatgatcaataactattcatttcttcctcatttccaataacgatttgctgcttttaagagcaagagatcacttttccttcatgttgttttgctagtggcaaatcagaaatggtttcgccagtattcactgatcttgtaatcactctcggaatccagctgcatctctagtgtagagttttgggtcaacaagaataawrmwgagcttaaagaattggactcagactcttgaagtcaggggttgatgagaaggtggctctaatctattcattcaacaacttcctattgagcacctgctatgtgccaggtgctgttctagccactaagatagagcaggtaataacatagggccattgtccttatggaatttgtattgtagtggggtgaataaaaaagggcagtctaggtggggcccggaaaaaaaaaaaaaaaaaaaaaaaactcga

SEQ ID NO: 657 - DNA, 300 bp, Homo sapiens
gaccatatgttgcaggaagtcaaactggactttttgtggctactaaatttgcctttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtaaaaaaaa

SEQ ID NO: 658 - DNA, 1466 bp, Homo sapiens
ggcacgagtgcctcaaagactattatttgggaggatctagtgcaaatgttagtaatgtggatattgtgtagtgtcccaggatattaatgtttttagcctcttggcttttattctgtattgttgccccaaaagatgatgctcacttatctttcatccagtgtaaggatatctggaaagacaacagaaagtatagctgttttcatttcaaaagtgatcagctgcttgagctagcaagcaaggcttgcactagcttccaggcgcagtcacgcagtttcacagcaggcgcggttccctcggagcacccagagctgccctgcggtagtcagcagttgtgctgtggctgcactgccaggctgggtggcargtggatcggagccagcagatgtggctcaggaagtgccttcttggcctctccttaatctctttcagastctgtgggcccttgattgcactgtgggttgtttcagactccagtattaggagactgaaccccttggtggttttttggtgtgtgtgtgctgagmtgggttgaggacatgttaagcaggtggggtgcytcccctgggtttgctccgggtggtacctgtggtgtggggtggttctgagtagttctggccccactgctggagtatctgcccaytcagtttgtgagatggcagggcttcatcctggtctggtgcctcattttcttctttagcagtgggcttagaaccaatgcagattcccaagttaagtattttttctgtagcttaattattacaggcttctggtacctaagccctttcttactttctgttctgaggggaagagaagataatgttgtttctccgccccccccggagtggccccaggaccttgcatggcatttgcagcatttgcagcgtgcttgggtttgctttactagggtgaaagtgttgcaccccccagcacccacaaaggcacctctgctcaccctccggtgaggttctgactggccctgggacatcacstgctccaggatcctatgtggctcatcccaggagagatgtgggagggaaggggaaaaaaggcttacatttgctgagtggaattcatgtagatctgagttccgcattgattcctaagctgcagagcccttatgccttggctgttttgtgaatgttagtcggtcttaacctttttcaccgagttagcattggctgtctcaggaggctcacagctcctgctcctcctccaggggagtgcgccctcctcctctgtcggtagctgtcaggtgcccctttcctctgcagcagactgtcctgggtccttgcctggccttccccttacacgtgagcctgcagcttcattcacagcccctgtgtagaaagataggcactaaaagcagctgactggcagccctagaaacatgaagggtttcatttatagtttcagtccttttccttctttcgagccttaatttaaaaaaaaaaaaaaaaaaactcgta

SEQ ID NO: 659 - DNA, 1019 bp, Homo sapiens
  misc_feature (126)..(126): n equals a,t,g, or c
  misc_feature (202)..(202): n equals a,t,g, or c
  misc_feature (380)..(380): n equals a,t,g, or c
  misc_feature (476)..(476): n equals a,t,g, or c
  misc_feature (511)..(511): n equals a,t,g, or c
gtctcactgtgccacgcaggtgccctgcagccacggagacgaatgtggacggccagaaggtgtaccgagactgtagctgtatccctcagaatctttcctctggttttggccatgccactgcagggnaaatgcacttcaacttgtcagagaaagcccctccttctggttttcatattcgttgtgaattttctttacattcctncagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcagraccagtgtggccagcanggctcctgcttggtgtaccagawtcggccatgagccgctacataytcatcatggggctcctgtacaagtgctgggcgtcctcttctttgccatagnctgcttcttawamaagcccctgtcggagtcttcanatggcytggraamttgtytgcccagccagtcctcagcccctgacagtgcccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtggcctgcagcccgaggaaggcttgtgtgtcctcagttaaaactgtgcatatcgaaatatattttgttatttaagcctgaaaaaaaaaaaaaaaaaaaaaaaaaaaa

SEQ ID NO: 660 - DNA, 973 bp, Homo sapiens
ggggactcagtcacacagaaaatagaagaatgtgtgtacagttggaaggtctcagagaaaaggagtctgttggacagaatgaccagtctgtgactactgccatttttcatgaccatatatcaacccacattacagatgtaacttagtgagagaaaacatctccctgttttccttcatatattatgaaatatttactttttctagtattttgtctatcttacgtcaaagatttaaatatctttgacctcctgtactaaataccacgccacatcagttttagttgcctttcttttttccttaggctagttttttggtataccatttctaaaccaatggtaggaacattttaaggcatcttttgtctggaatawgttttagcatgtmcagcatgaaagttttatatgtttattaatttttgtttataattgttaatgaatattaattttgttaatgaatatatattaaaccaattaataaacagtcacaaagctgcaaaccgktttaataattattaaagttttaattttttaatggattttggtcatctaagttccgaaatgaaatacaccaaacttgttcttactttgccaaattgtcctactgtttctcagaatcaacatttttagacattatgtagaaacactctttaacctagttgtstcaggcttagtagagaaaggaaaagaaagaaagttggagctggaagaggaaagttggtaaatgtggtcagtagtgcattttgtgtgaccaggcaagttctgcagaacctcttctgaacaccttcacctgtgtaaaatcccaggcattagttaatctccaaccactatggcaggatatgcatctgagagcaaagaggcaaatggcaagcagagatcacaaaggtgcaagagctagagtagtgatagaaccagtgccaggacgatctaaattcccttgcattgtcaatacrcaaaaaaaaaaaaaaaaaactcga

SEQ ID NO: 661 - DNA, 1430 bp, Homo sapiens
ggcacgagcacttatgtgtttggcattctccgtcatcattctggccggggcgggcagttctaggagttggaactcagtcctggtggaaaaggaagtcgtggagggagggctagggccgtgggggaactgctctgctgagcctcttcctcacctgctgcttcctaggactaacctgaaaggctaaggtaccaggctgaagtcagtgctcagaaaaccaatcgtcattctttggggttttttttcttgaagagccactttctctttaccttgttctagcctgttggaggtagggtttctgcaattccaaaggccgtacacagcctctcaccatcagaccactttttaaggctcttcgttcatacctagctcgaagattcacttcctcaggaagccattttagttacaaatctgggaaaacttaaaatgctttcattgtgccatgttttctgttgcagcttcagtaccgtacctagtggtcaggcatacttacaagtttctttttacagtaaccccttgtggacatctaataaatggtcattattttttagtactagtttgttttcctgaacactgtaagatctgtgactgacgtttgataccttaaagcagtgccatataataactacccactatttgttctttatttctgtcagataaaaatgttctatgtagtgtctacagtcattttttttttaactagaatttagatttggaagtagtttttctattagttgatttgcatgaaatacaaaattaggaaaaggcttattccacctcaacctagttgaactattaatgatttttttttttttttgaggatttgggctctttctagatagaaaatcaccctgaacttctagctttgcattgtgaagtgagcatcatgaagatgagaaaatgttgggagatcatttttgcaaagggcataatagtcggcattcagatatgagttaactgcagagggaaaattgcaagctgtcatgttggccttgttcctctcaaccttctggtaacctaacaagctcctacaggttgtatgtgaaattgcaagatgattatatagccctgttgaatttacaaccagatcttgctttcaaaccattattagccaagggtttgattccacacctgtgttcatggattttttggtattagacattgctgtaactctgttttcactttttcatctgttatcttggctcacttaagggagaaggtatcagcagcctaggaccacttggtttctgtttttatgtttcatagttcatggctgataaaaattacctgtccttaggccgagtgcagtgcctcacacctgtaatcccagcactttgggaggccgaggtgagtagatcacctgagatcaggagttcgagaccagcctggacaacaagagcaaaactccatctccaaaaaaaaaaaaaaaaaaa

SEQ ID NO: 662 - DNA, 1499 bp, Homo sapiens
  misc_feature (52)..(52): n equals a,t,g, or c
  misc_feature (66)..(66): n equals a,t,g, or c
  misc_feature (84)..(84): n equals a,t,g, or c
agcttattgcaaagacaaatgtttgaagtgtttgttgagatttcctgttgtncttcctgaggcagncacagcataagctctttnaccctctacttctcagcacataagctttcttaccatctatcactggagtcaggggtgaggggaggaccgcatgacagttggttaatatacacttattttttggcaaaaacgttttctctgggaccagaatgatcttgatactgaaaaaatttctagtgctagatcctctttctaagtgtgaaaggacttatctggaatgctccagaatgatcccaagtgttgagctgagagggacctggcagcagaatctgattattgaaaagtggcaattgttgatttattgaagacagaataataactcagcagaactgttatgttgagctgaacccgacctccttcagccgaatcatgcaagaatgcctgctgcatggctgttgctgctacttattaaggcttggtgttctgggcacagtgcaatgcatttctacatggttgatcctcacagcaaatgaacaacacaggcttaaggaaacaagcaactctcaaagtcctgcagtgagtagagcttagctgttggtagtcaacatgccacgcgattcggragttgagcctgtctccagaggttagagatgttcagtttcctcttaaggttcttacgtagatttttttcatgactttatctacatcctccttaaatttacgtttttagtccttactggctcttgatatcaccagttttgttgttattagtaatttctaactgccctaaatttgtctgttttaagattcaagggatgatacctcagtctgttatctggaatatggtttacaaatccattttttctcttcaaggctttgaaaacattgacattgtctcctcctaacatttttatttgtcttgcagactcctaatttatttaatttatcgttaggaagacgacttttctgtcttttgatgattttagctgcccttctctagaccttgctgattccattatctttaccaagaattgaaagtgaaagtggcatttgtcatagaatgccatggtcttattccaaagtatcttaggatggaacaatacaaggcataatatggggtcagtgaggtttgttacacgagtgaatgaccaacaacactactgtctgttcaaacccagtctgaagggtgaatcagaccgaccattggccgtgagggtctggactgctcagtattatctcaaggatatcaagggttattggaaactgtgtgatcaaaggggctccatgactttatgcagggattcagtagggagccaagaaggttgagaatagttcagagaccagagtctaagaccaatcaagaagaatggatcaattagagatatgaattctggtgcttatatttttgtggagctggttgtgagataaaaggtcaagcctaccagactgaaaagtgtatgtgaaagctctttaaaaaaaaaaaaaaaaaactcgag

SEQ ID NO: 663 - DNA, 1558 bp, Homo sapiens
gcacatgcggccttgcagctctccttacgcacatgcgggccttgtagctctccttacccacatgcgggccttgccgctctccttacccacatgtgggccttgcagctctccttacccacatgcggccttgcagctctccttacccacatgcggccttgcagctctccttacccacatgcgggccttgccgctctccttacccacatggggccttgccgctctccttacccacatgggggtcttgcagctgtccttacgcacatgcgggccttgcagctctccttacccacatggggccttgcagctctccttacccacatgcggccttgcagctctccttacccacatgcgggccttgcatgctgttggctctggagcctctcgtctcacaggtctctacaggtgcaggccactcaccgtctggtggtcaggaccataaaggacagggttatgttaaaggttttgcctcaaaccagaaggcgaggaccctttctgtccagttgccggaatgatgtcatgaggaactgtgtgcccaggcacgctgtgctagttacaacatgtgtttttgtttcattccccacacactgtaaggtgggcatcactgggcccatcacacaggtgaaacagaagcccgggaatcactcgtccccttgcccagtcatacaactagtagccaaggcagaatttgaactcatgttgccctcagtcccaaaacctgtgtacttaacccttgttctctcctgctggtgtctgtgtgatgtcccatgtctgtctgtctctctctaaagggacagtgacacaccaggaggatacccagatgctggggggccttgggacagagtctgggaggattgagtgaaggagcaggtgagggtgagcctggagagagaacgccctggtggagagtttatgtagaaaggggattaggtctccgggaggaaccggatccatgtggtctgctgagatggctgagtctggcattcagatgtgccacccaacagaagaggccctggagggacgccccctttgctgggtggcagccgtgggattccggggtctgccttggaggtcctggagaggatgtcgtggccctggccctagactcaagctgcctgggtccagttcagcccggccactcctgctgtgggccctagccaggggccttcactccaccgactgctgtgtgtttggtacatggtgtcacccaggccatgtgcttagcaatgtgcctgacagccagtgccggtgtcagccattacagggacacacgtgcctggaggttgaggccacgttctgtcacctaggcccgctcgtggtcctgggctgggccaaacccccctttgaaaggattcctttttgcccctggcataggctctcattgtcctagtgaacagctacatctttttaacaagccagaaaaggccagctggcagtggctctgcctgaaatcccaagactggctggccgaagcaggaggatcacttgaggccagcctggccaaagtaagcaagactctgtctctacaaaaaaataacaaaaaaaaaaaaaaaaactcgag

SEQ ID NO: 664 - DNA, 549 bp, Homo sapiens
  misc_feature (474)..(474): n equals a,t,g, or c
  misc_feature (484)..(484): n equals a,t,g, or c
  misc_feature (528)..(528): n equals a,t,g, or c
gaattcggcagagcagatgcttcccactagagaagctaagaagctgtggcagccacasccgggacagggcctggcctccagcccagggctttccctgatgtccagcctcagctgcctcttcctgcctcatcccacccgcaagaggwgctggggaccaragacagagacacaaactccatttgaatgtgaaccttggcaccatggagatgctcagggtgagcccagtctgctctctcattagtatgaatttccttgtgtttctgtctctctcctcttccctggtatcagctgctggkcccaggtttccttccagagaggagcggggggtgggtggggtggtgctgattaaatctgaggacatgacattgrgcgagagaagcaaggggagctgstgacctccctggatggataaccatcaggaggcggtarcagagtycamataccatcaccttctcctgcagatgttggttcagncactttcctnctaccacagatgggctatgtgtttcaaagcagaagagcagaganggcagagaaccccagctggtt

SEQ ID NO: 665 - DNA, 1294 bp, Homo sapiens
ctgcagaattcggcacgaggttatttcacctctcttggcctcagtttctctgtgaaatcaggaattaacatggtctctgagacccccttctgatggtgaatgtgtggtttggtgattttgtggccctgcatcatgaccttatttagttctctttcaacaggggatgttttactgccttgtaaaatcctcgtgggactgcgtgtctttataggagccagggtgtaaatgaacagaattcagattggttctaatatattttacctctaaaagaaagggcatggggaggccatgaccttaaagcaggttttttctgttgtctgtgaagcctgtgatgattgagagtggctgggactggcgggacgatgtttgggtggaagagggaggccatctcgatgcgccccgtcccggggaggcacccagcctgtaaggaggtgatgtctatctacactgagcgcaaggaccctgaaccgggggaggctgaggcggggcctcttgattcccaccctgtcccccagtggctaggctagtgtggcccgggaaatgacttccatctctccctccaggcatatttaataagaggccagtattttcagattctgccgcttctggacgaatgtctcagagagctgggaggcgccctggaggatggaacccttccttgagcgttgttgaggtgtgtcgggggtgccgtggcacaggccccctcccctggggggcatcactgttcccttgctctgcatccccgctgtttcccctgcccctgaacaggcgtggagatgtgcacgggacactcggaggccggatgctcaacagagtggagtgccgcgacggtgtggccgcagcctggctgtgccttcacgacgcagctgcaatcagaggagctgtgggacgctgtcccatgtggacacagcccactcactgggtgctgctcctgtgctgggcgctgcacttttattgtcgttaaaaatttatattaagatgcggccgggcatggtggctcatgcttgtaatcccagcaccttgggaggccgagacgggcggatcacgaggtcaggagatcgagaccatcctggcttacatggtgaaaccccgtctctactaaaaatacaaaaaaattagccgggtgtagtggtgagtgcctgtagtcccagctactcgggaggctgaggcaggagaatggcgtgaacccgggaggcggagcttgcagtgagccgagatcgtgccactgctctccagcctgggcgactgagcgaaactccgtctcaaaaaaaaaaaaaaaaaaaaaaaactcgag

SEQ ID NO: 666 - DNA, 904 bp, Homo sapiens
ggcacgagatcgtcttgtgacaagacttgctgagaagcaccttaaaattcactgtgagccacattttgtcttttactgtctcatcggatagggtagatcaatgtcctttactgtagcagagactctctcatgggcaggaccatcatggaaagttctgactacatcaagaaaggcgccaatgtctcacctgtgcttggggtcaggcagcaggctgtgatgccggtgcctctctggttggtactgtggttctgcttcctgttatatgtagcctcacgaaggacctttggattagccaattacatgcccctaccctgagcttcttccccagctctttgacttcctggacattggtgaatatcctgaataagcaaaagggataaaattcatagaaatatggtggcaaaaatatacaacttcagcccagttctttgggtccatgttggtaaggagtccagttggcaagacaagctgcccaaggaagtgcctcagaagtctgggtcaaagaggagggccagatctgttctgtgagaccctatgtgattgttatatttttaaataatatataattaagcaggacaaattaaatactccatggctttggggaaattgttgctttaaagtcctggaatggggctgggcacggtggctcatgcctattaatcccagcactttgggaagccaaagtgggtggatcacctgaggtcaggagttcaagaccagcctggccaacatggcaaaaccctgtccatggtggtgtgcgaggctgaggcaagaaaatcgcttgaacccgagaggcagaggttgcagtgacctgagattgcgccactgcactccaacctgggtgacagaatgagactccgtctcaaaaaaaaaaaaaaaaaaaaaaaaaaaaaaaaaaaaaaaa

SEQ ID NO: 667 - DNA, 1374 bp, Homo sapiens
ggcacgaggtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggcctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggccttcatccgttaaaaaaaaaaaaaaaaaaaaa

SEQ ID NO: 668 - DNA, 3435 bp, Homo sapiens
  misc_feature (760)..(760): n equals a,t,g, or c
cgagcagcatcagaaagtacgawtctgctctgagggcgratgraaaatgaagawtctgacgtaaagcctccagactkgccaaacccaatgaatgctacctcccagtttcctcagcctcagcactttgcagctttggcctccgtctgcctcgggatatcacagagctgcccgagtgragtaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaakaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcanatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatggraggaagttaccaccgtacatcattttraggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatsccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacaagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagamaaaaaaaaaaaaaaaaaaaaaaa

SEQ ID NO: 669 - DNA, 652 bp, Homo sapiens
gaattcggcacgagcaacagtggggcactctgctcccaggcaggtcccactgggctgagccgcacagcctggctttgggcttccctgactgcaccacccacatcasctgcctctagcccttaamatacaaaacttcccccagtcactggccgccaggctgagttgggggatgtgttacatccctgggtccactggggggcagtgttggccatggtgttggtgctggctctgccgagaggcgttggagtggctgtgtggggcggtgagcgccggcccagcctgatggaacccactgtaccaggcccaggcctcagcctctgagaaggacttccctgtgtcactcactcatacatgtcctcaggacgtgaagacatttcagcagaccaaagtttccttcgaatttccttcgaatcgtccagatacttggagacatctcctcctcacctgtggggtgctggggcagtcctaggcgtgggggcagatgggtggacagctgctgctgccctgctgggggtgggcagcccttggagcacacagtggtgaagacattcctgaatatgtctcaggctgtagaaatcttattttgtggaaagattttagagaatcatcaaaataaacttttaccaaataaaaaaaaaaaaaaaaaactcga

SEQ ID NO: 670 - DNA, 1711 bp, Homo sapiens
ggcacgagcgctcctgtcctgccactgagggacccggttaccaaccctcatgtagctcagtttgcccatctgtcccggtgctaacacacagttctcgggagactttccccattcccagaggagtagtgcgaaatgcgtgtacctctagtcttaagctgggcgtttgtattagttgggttttctggtgtctatttagcaagtgaaagtttctggttccctccttcactgtgtgacctgactagtcctcctggattgcatttatggaagtttatacgagacctagtttccatggaggaactcactgattccgcgagggagatggggtactggatgatggtcttcagccttaaggctatgtttccagtgtcctctgggtgtttccaagagcggcaagaaacgaataaatctctgacccttctcaggtgcagccagagagacactagcccactgatggacggacagacgtgggcaagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaacgagttttgagaagcgggtaagctgtatgttttgtggttttgtttcataaattcatctacaggaagaccaatattgactgaatgaagctttcatttaaagagctaaaatatgctttgtgtttttatatgtggatactactttaaacctaacgactattcattgtatcatagcttgtgatgtattctgctcatggcttttaaggtaaattgtgccatgatccactgccattctaattgctttaacaagtcattaccacactactgttacatcttaattatgcatacagacaggtagacttgttttacatatgtgaactaactagttgtcaaagcaaatgcagattgtattctgcaagtaaagtctttttctctctgaaatttctagggatgttctttaagtgaaattcatattaaaactgaagattttagttacaagaactgagtgcagattaagtctttgtgattcaacatagtcaagatacaactgtggatatttcatggaagtatgcaataaaatgtctctacctggaaaaatctatcaagcagcgtcacagtactgaatttgaaaccagaaatactgggtttttatataaatgcttcatagatttgttttatgataaagggcacataactctcctaaacctcacaccacctcttgaataggtataataagtccacatcaatgctgatgccttagctattattaaactcttacagtatgatgtaaagtgaaagtacaatgtaagatcattcctaggccaactttgaccagttttatacagaaacatgtgccaacttttctgtttgcaaggataatatcaaagcaaacaccagaaagttatatctttgatgcattttttcaaaatcatacacataatacacaaaccaaagacaaatgatgaatattacgtcagaaaatataaagtcttcccctttcttcttttgccaagaaagtccaatattttcaccatttttatgcacacaatcaactttatttaagctggaagttaatgtctcattgttttcattgttctaaataaacaccttttcccttgagtattgctctaaaaaaaaaaaaaaaaaaaaa

SEQ ID NO: 671 - DNA, 2058 bp, Homo sapiens
ggcacgagctcaaagagtaagaatccaagtgtgtgacattacatagctttgcatctatggaaacctaaatcataattgtttccactgcccaattatgttccttttcataacatttactattctggctatatttatcatagaacctaggaaccttagagttgacctgaatctaattaaatttcagacctcctggccaaagaccctagtggaagagcaaaactaaatcaacatattaccaatctcaagtatttctctgaggacccagaccactgactttttgttgtcattttcaggttgatcctataactgtatgttctacaatatctgtgctccaccagctcagtgaggaatcaacggaatatcaaaagtaaatattggtcaccatataccttttggtactagtctacgaaataattggctgaggaactgtttcatattaaagaaaagctaaaagcaatgtgtgatcttagattagacctatgattggaatgtatgtatattttatatacaaaatattgaggaaattgacaaaatttaaatacagaatatggattagataataggaatgtatcaaggtcaatatttaaaaagataatttcaacttttattttattcagtgggtacatgtgcagactttgttttacatagtacccaacagtttttcaacgcttatcccccaccctctagtaatctgcagtgtctattattgtcatcttcgtggctattgtacatgggattccatacttgattttgctctcaacatgaacattattggtgtagagaaatgccactaagttttgtacgttgcttttgtatcctgaaactttgctaaagttatttatcatttccaggagcctttcgttggagtctttagggttttctagttagagagtcatcagtgaagagagataatttgacttcttcttttcctttttgggtgccttttacttctttctcttccctgattgctctggctagggtttctaacatcaaattttttgatgttgatcattatactgtagttatgcaggggaatgtctttgttctttctaaagaacattcaatgttaaacattgaaatgtttaacaatgaaagatcattatatgtaatttactctcaaatggtcaagggagaggagagagaaagagacagagagaaagaataagaaaagagagtgagtaaatggggcaaaatgcaaacaatttgtcaatctatgtaaaatgtttacaagagttctgtgttacatttttgcaactcttctgtatgtttaaaataatgttaaaataacaattttcccaaatgtcaaatgttgccacatacaagcatttatgagcatggaaaatgtggcttctgaatgataggatacaaaatctggtgatgagcgaatacactgaatatatcaagattgagttgccatcttagaaggagaatattagctataaatcacatgatgaatacatcaatattaaatagactagaaaaccaataattataaggtcacaagagtgcaataaacatgaattatctccattgcatgtattttcatctctacttgccagttttatgagattcagtccccaatatattttcaattaattcaacatagaagattcacttctagtatgttttcaaattgtttcaaaccctgaccatctttttgattgctctaccttccaaaagaaaagaagggaacactaattttctttcctgatttacttcattgttttcttctgttagattaactttacctataaaagattgtctcttgactttatatatatatatatgtgtgtgtgtgtgtgtgtgtgtgtgtgtgtgtgtgtgtgtgtgtatttgaagaggacatgtgcctccataaaaggaaataaaatgagagaatacattattgattttgtgaaatcaaaatatttgaattatggtttctcaatattcaaaaactcttgcagtttctgtacttatttcttctgatgcatagagtttcggggactacatatgtttcacaaccaaagatatccacttgaaataaaaacattataaagttaaaaaaaaaaaaaaaaa

SEQ ID NO: 672 - DNA, 3059 bp, Homo sapiens
ggcacgagctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcgcgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaacgaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctcctcaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggccacagtgtttgctaatggatgtgtttttatgattatacattttccccaccataaaactctgtttgccttaattcccacattaatttaacttttcctcctatacccaaatccacccatggaatagttaattggaacacctgcctttgtgaggctccaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaaaaaaaaaaaaaaaa

SEQ ID NO: 673 - DNA, 1963 bp, Homo sapiens
  misc_feature (5)..(5): n equals a,t,g, or c
  misc_feature (1116)..(1116): n equals a,t,g, or c
  misc_feature (1253)..(1253): n equals a,t,g, or c
ggtanctgcagtacggtccgattcccgggtcgacccacgcgtccggagaaatgcaaattaaaacagtaaagtgtcattttcacttcctggattggcaaagggttttatgtattttactgacagtgctcaacattagcagtaaacaacaaatggtgagtaaatatgagcttcggaacctcagggaaatgatctccttatttcaacctgcagattccttcctacaaccagtgtagagcagagtaccaggacgggccattgagcaccctggtgttgagatcaagtggcctctagtcagagttgggtcagggccactgtgagtgggctgcccccaacatgagtcagctgtctaggactagtttatctctgcttctcactttactggtattatggggcagctcctgctgtcttccaatttggtgtcttccaaatcggcaccgtcttttaaagttgagtttcttgttattctcacctgatataccttatttatcccacacccaccccaataacatatcgtgctcagtgttatctttgagacaacacttgaattttactcagcctggagcgctcttcacatgtcttgtccagatccagttcggactcattcttcagccgtgcatcagtaaatgggggctaggttaaactgtggtgacaaacaacctccaaatttcagtggctcaaaaatcttcttcctcatttatwtacatttcatcatgggtcaggtgagaggtagctctgtgctgtgtcatcctaacacaggaatccagacggaaggagggacaatcaataagatccccattgctatagaaaagaraaaaaagtatgcggaatarcactcygtttcytggagawtyctcctgaaaaagtcacatgttatttcttctcacctccattggcaaaaaaaaagtcatgtggccatgtgaaaatgtaagtaggcgggatggaacagtcagaatgcattcataaaatatgaactgaaaatatctggagaacakcacctatgactaccacgaatgccaacatgcatccctaacaacccagtgctgtcaccctccaaactttttatgtcttgcaaagtattagaacttcttatctgaagccataccactcagagggaangcaaaatacatattgacatctcctttaggatgtccttagagaattcaaggaaaagaagttaaataattttaaagtgcttttgggtacagctatttagcactagagggtaagattagacatagattgtaaagataatnatagggttagggataggattaggatctgggtcagagtcaggsccagaagtatggttagaggtggggtcatggtcagggtsgagatcaaagtcagggtcaaagtaagggtcagaattagggacccaggatagggatcaggatttaggttcagtgtcaaagtcttgggacaaggttagggttagaattagaaccagagctttgttctcctcaggacccacccgagggtgggtcaccatggctttggagcgcctggtagtgtggtgtgtccacagkgaagaccagagtttcattgtccttaagactgacytggggagatgtggctgtagsccattgaggaaggtgaggcaacagcttcctgtctgctyccccgtgtgctgaggagggagttctgccatgggctttactttcacatgttatattccacaagtcttgttttacaaaagcatcccttccttgaggcttcggctgctcatcgctgctcatcatmatagcgtgccataacatatagtaagatttgggtttgtttctggggagatatcttggtatagagaaaggagaaatgcttagagccaccatcaggacagttgggatgaaagttgggtataggcagaggctggaggaaacatgtgcatcccctgtaaacacttttattcatgttttaattactcatttttcttacagtgttaaattagtaaagatagtattgaaaa

SEQ ID NO: 674 - DNA, 963 bp, Homo sapiens
  misc_feature (2)..(2): n equals a,t,g, or c
tncagaggccctgcggagttgttcagaaccccaactctctctggctggctaccccctgaactactgggtctctggacccattgtgcccagccacccccaaaagccctcaggcgagagctgcctgaggaggcaccgctgaggaggaaaggagaaagattgaagttccaagtgagattgagagatctccctagaggcagctgaagaggagaagtcccgcatcagcctcatcccaccagaagaacggtggtaagcggccaggctccgtggragccagggcccamagcccttggccagktkgtggaaacagctgctgggatgggtatgccccttgtcactgtcacagctgccaccttccctactctctcatgtcctcctagggcctggcctgaggtggaggcgccagaagctcctgcattgcccgtggtgcctgaactccctgaggtgcccatggagatgcctttggtgctgcccccagagctcgagctgctctcactggaagcagtgcacaggtaccaggraggtggcaccttgatggggtggacccgggctgaagcctctgctaatggttcttgatccctatagggcagtggcactggagytgcaggctaacagggagcccgacttcagcagcctggtgtcamctctcagcccccgcaggatggctgcccgggtcttctamctgctcctgggtgartgtatgcatgtgtgtgtgtgtatgtkgggcagggacacagagaccagaggcccgtacagggactcccccgacctgccctctcctcgcctcttgaccagtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgaaaaaaaaaaaaaaagg

SEQ ID NO: 675 - DNA, 911 bp, Homo sapiens
  misc_feature (911)..(911): n equals a,t,g, or c
gtctgaccaggggtactaaataaaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaaaaaaaaaaaaaaaaaaaaaaactcgagggggggcccggtacccaattcgccatatggtgatggcaaatgggaan

SEQ ID NO: 676 - DNA, 407 bp, Homo sapiens
gaattcggcacgagctcgtgccgaattcggcacgaggttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaaaaaaactcgag

SEQ ID NO: 677 - DNA, 675 bp, Homo sapiens
ggcacgagctgctcttcttcttcaacatgctcttctgggtgatttccatggtgatggtggctgtgggtgtctacgctcggctaatgaagcatgcagttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaaggtatgggtcagccagtggtctgggggactgtgggtaaaagtgaatgtcatcccaagagatgcctcaccctctatgcctgtggggctcttcattacctgccaggtaatggcttctgggaaggggtttggcaaaaaaagcacacgtagcagagtgctttaaatgtacttttaaagacacagaacagtatatatagtaatctactgtgttataaatggttacttacagggggtgaggaactgggcagattcttgaatattacctcttcaaaagtgacattttaggctggtccaaagggagtgagttatctcatttgattgttcacagtcagctacagatccaactccttgttctactctttccccccttctcagtgctgcacttgactagactaaaaaaaaaaaaaaaaaa

SEQ ID NO: 678 - DNA, 1134 bp, Homo sapiens
  misc_feature (1)..(1): n equals a,t,g, or c
  misc_feature (1134)..(1134): n equals a,t,g, or c
ncgccccggactcttctcagttgagagtgcggttcctgggcaggtttccacaccagttcctttccgcgtccttcggccctggctctggctgcctggcggaggtggggtagcatttgtcatttgcacactgctggctttatctttggggctgcaccccgaggcaacaaatgcaggatgctctgtcacccacatgtccaccaccatctggtttgccttttggctactttgactttctccttaaatgcttcctgtgctgagcaaacattccacagccagcagagcaatggagagttcatggccactcttcccagtatcagcaagcaatttggggtgatcgtttggaagcctcagaggaaagatgtcatcaggcttcctgtggctttgtccttcagcagtggggctcggcttgctttcacctgccttaggaagatttctggcttccgagctctgatatggggagaagataagggctgggatctttgagtctgcccctagctgggtatgtgcgtccggtgtgcgggccttggagtttttggtaatgactcacttgtgctctttctgggatctgtctccctcccacatgaccccgtggggtccctgaatgactgttttagagtacccatgtgggttccctgagtcacagcaggggatgtttaataaggaggttagcactgagcttggggacgtgctgtcacaccagcaggacgctgcaggaaggagcaggctacttcctttcttgacgtgcaaataactcgtataggctaatcaacaggcttataagttaaaagggctaccgctcggccccttggggattccatcccctcctctgtaacttggagatgtttgtttctgctgcagactcagagggttgcgatgaagagtggtgggactgagttgagaagcttatcccttcgctgggtgggaggtttctaattgccccgttctttgggggatccttaagtccagcttccaggtgggggcagcgataggaccaagttctcctagtagtctctgggaagccacttgagggaagctgccggtcatcccatgcacccattggtcttctccagcaggccctgtaggtcgtccatgttccatgccttctgggttcttgggggagaaggaagctgttgn

SEQ ID NO: 679 - DNA, 1583 bp, Homo sapiens
ggcacgagggacaacgactatctgctacatggtcatagacctcccatgttctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaatttttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagacacttggcattcaaaaaaaaaaaaaaaaaaaaaa

SEQ ID NO: 680 - DNA, 1991 bp, Homo sapiens
  misc_feature (300)..(300): n equals a,t,g, or c
  misc_feature (353)..(353): n equals a,t,g, or c
gcgacgctcggcccgaagatggcggccgaatggggcggaggagtgggttactcgggctcaggcccggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaantgktgaasagttgctccctgagaaaaagaatcttgtaaagaacaagcttctcncacawgcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctyccaccttttaattatagtctgggattatatcaatggagtgataaagtagttcgaaaagtgragagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactggctggtataaagcaaattacagcatggctgagaagttagactggggccgaggaatgggctgtgactttgtcaggaagagctgtaaattctggattgatcagcagagacaaaagagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgscctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcga

SEQ ID NO: 681 - DNA, 2398 bp, Homo sapiens
  misc_feature (1874)..(1874): n equals a,t,g, or c
attgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctgggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttcyttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgmccaattgcactcttccacatagaagccttgatgtagaacacacaattttgtatagcaataatagcactgcaaacaaatcytctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacaytgagagccgtgcccgcagattacaaaagcgcttacaggttgtgcaagccaagcaggttgagaggcatatacaacatcagctgggtggatttttggagaagactttgagcaaactgccaaacttggaatcsttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgttstttgtacataggtgtytagttcygttngttttttccctgatgttgggtagatgagtgcatatacatgctagtgaagaaggggaagatactttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaaaaaaaaaaaactcgrgggggggcccgtacccaatcgcccctcatga

SEQ ID NO: 682 - DNA, 975 bp, Homo sapiens
accctactaaagggaacaaagctggagctccaccgcggtggcggccgctctagaactagtggatcccccgggctgcaggaattcggcacgaggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgttttycctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaaaaaaaaaaaaacccaagggggg

SEQ ID NO: 683 - DNA, 1209 bp, Homo sapiens
ggccacgagagtggatgccattcaccaacccggcccgcaaggacggagcaatgttcttccactggcgacgtgcagcggaggagggcaaggactacccctctgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaaaaaaaaaaaaaaaaaaaaaaaaaaaa

SEQ ID NO: 684 - DNA, 2135 bp, Homo sapiens
cttaatgaactggttacaggggctgctgggctggaggttgaggatcttcacgaaaaacatattaaaacaaacccagaagaactgagagagattgtgacatctatacttgaagaatacacaagtcaagaaaattggtattaggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagttagcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatatttcataccttgtgttttcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtaaaaaa

SEQ ID NO: 685 - DNA, 1193 bp, Homo sapiens
cagccccgccttctctacacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggccagtccatccatgggccgccctcggagagaggct

SEQ ID NO: 686 - DNA, 868 bp, Homo sapiens
gactgactatagggaaagctggtacgcctgcaggtaccggtccggaattccgggtcgacccacgcgtccgctgaatttaggagactttttacccaggggcaaaaggctcttagggtaatgagatggatggtggcccaggtgcattttccagggcctgggttctccagatcccgtggcttctgttgagtggaggcaactttgctctgtgtgaacctcgcccctgtccctctgccgggcacccctggcaggaagcaggactcccatcctcaccctgacttagactgtcctctgagtcagctcctctccaagacaggagtgggcagccctgggcagtcttctggccccttgctaaagtgagggscaggaagctggggctgccctccagaaagccggggtaggractctgaaaaatacctcctctaaacggaagcagggytctccagttccacttggcgccccctcccacaaggcccttcctccctgaggaccccacccccctaccccttccccagcagcctttggaccctcacctctctccggtgtccgtgggtcctcagcccagggtgagctgcagtcaggcgggatgggacgggcaggccagaggtcagccagctcctagcagagaagagccagccagaccccaaccctgtctcttgtccatgccctttgtgatttcagtcttggtagacttgtatttggagttttgtgcttcaaagtttttgtttttgtttgtttggtttttgttttgagggggtggggggggatacagagcagctgatcaatttgtatttatttattttaacattttactaaataaagccaaataaagcctcaaaaaaaaaaaaaaaaaaaaaaaaagggcggccgc

SEQ ID NO: 687 - DNA, 518 bp, Homo sapiens
acgcgtccgagatacattccatgaatacctagtttattgagagtttttagcatgaaggactgtcgaattttgtcaaaggctttttctgcatctattgagataatcatgtggtttttgtctttggttctgtttatgtgatggactatgtttattgatttgcatatgttgaaccagccttgcatctcagggatgaagccaactcgatcgttgtggataagctttttgatgtgctgctggatttggtttgccaatattttattgaggatttttgcatcagtgttcttcagggatattggtctaaaattctcttttttttgttgtgtctctgccaggctttggtatcaggatgatgctggcctcataaatgagttagggaggattccctctttctattgatcagaatagtttcagaaggaatggtaccagctcttctttgtacctctggtagaatttgggtgtgaatctatcttgtcctggaatatttttggggttggaactcaaaaaaaaaaaaaaaaaaa

SEQ ID NO: 688 - DNA, 853 bp, Homo sapiens
  misc_feature (1)..(1): n equals a,t,g, or c
  misc_feature (75)..(75): n equals a,t,g, or c
naaggcaaatttcttcctcagtcgtgtggcaggccctgagcaggcagctgggtgtccccgctcagatccaggccncgaatgggctgggcgggttgcagaagccatcacctgagctacccagggtgggatccctggccccgacctctgtcctgacacgccccaagcggcagcaacaaagccccaattggcctgggcctgggcaggaggagctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggttat

SEQ ID NO: 689 - DNA, 1757 bp, Homo sapiens
aggctttccacccagaccgtcaacttcgggacagtgggggagacggtcacccttcacatctgcccagacagggatggggatgaggcggcacagcctgatgctgctgccatggtggcttggggcagcggggagaaaggagtgtcacagggagcagctcgtggctgcagtggaagtcactgagcaagagactaaagtccccaagaaaaccgtcatcatagaagagaccatcaccactgtggtgaagagcccacgtggccaacgacggtyccccagcaagtccccctcccgctcaccttcccgctgctctgccagcccgctgaggccaggcctactggcccccgacctgctgtacctgccaggtgctggccagccccgcaggccggargcagaaccaggccagaagcccrtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtgggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgtcsctggccwcgggccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcaaaaaaaaaaaaaaaaaaaaaactcgagcggcacgag

SEQ ID NO: 690 - DNA, 2234 bp, Homo sapiens
  misc_feature (5)..(5): n equals a,t,g, or c
  misc_feature (136)..(136): n equals a,t,g, or c
ggctncaaagtggtccctgtcggaaagtaatttaatcaactggagaactcccggagtccagcccccaactcccccaccccccatcccagtgggaatgccaccaacagcccatctcaacaatttcccaaagtaacantctccaggtggaagacctgtgaagtatccccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaggggattttggttttggttttgggttttgtttttttgcggtgggggggctggtatttggaagaatttagctctttatgttacagaaatcttttttgcaaggacttagaaatgataatgcttaagattgttcttgcccmatgtgggaagagaatctaaggtttttatatgtcttgcaacctcatcaaaggaaaattactggcatcatttycataatttgaaaaaaaaagccaaattaatatatttcttttttgattcactttttaagtgatcatttttaaaactttacttttgacccactgaatttatttagatagaaggaaaagagatgatgggagggaagtttagataaaggatggaagttggttttatttaaacaatagcccygtgatttccyaatgagaagtgactagaaattgaagaaaccaaataaggrggrtawtggkcaatttagcyttagtttctcttactctctcaagcctgccctgtttaactccaaagttcatggctcataatttgagaaacactgttttaaacacaggagaaaaaaatgtccattttaaatcatagctattgaattctacaattacaaagaaacaaacaaacaaaatttgaccaacccaggcggttaaatttaaactcttcaggaaaaatttaagctgttaamattattctttttctaaatttctaaagtggagggacagaatttttcagatttaaaagggcctcctaggtgcccagaaaattagtggaaagaaccacgtctagacgcatctttgatgtgtcagagttccaaggataaaaagaaacttttaaagtcttctatactcagccaggttatcaatcaaatatgagggcaaaataatattttcagacagattttaggcagtttatcttccatatatccttttctttaagggtatttgtagatacactccagaaaaacaagagtgaaatatgaaggaagttgtggggtccagcaaacagtgcttccaaatcagacccctgatagaggtggaaaactttgcaatgcaacaactgcgtagctggcttagaggacagcctacagatggwwcagaaagatgagsatgggattgagggatcagggattgaggtctccaagaataaaaagggacttcatggaaaaagtaggcttgtggataattaatcacaggggcaaataatgcagttaaaataacaacatgacaatcaggtggaggaatgtataataaacccaaatgtggctgggtagagtggctcacacctgtaatcccagcactttgggaggccaagccgggcagattacctgaggtcaggagttcgagaccagcttggccaacatggcgaaaccccgtctctactaaaaatacaaaaattagccaggcttgggggcgcacgcytgtagtcccagctcctcaggagctgaggtaggagaatcacttgaacccaggaggcaaagggtgcagggagttgagcccaagatcgcgccattgcaccctagcctgggcaacagagcgagattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcaatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagtaaaaaaaaaaaaaaaaaactcgtag

SEQ ID NO: 691 - DNA, 2733 bp, Homo sapiens
gtgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcaggtgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaaaaaaaaaaaaa

SEQ ID NO: 692 - DNA, 1010 bp, Homo sapiens
gcgtccgtatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaaaaaaaaaaa

SEQ ID NO: 693 - DNA, 2561 bp, Homo sapiens
cccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattacattggtggtcttgacttttattacagaaagatatgtagtaaatattcagaacagatacacaatgttacttggacatttcagaattatcagagaacatagcataggcagataatttttgtaagggttttctgtttgtttgttttttttttttttagcagcgctctgtcttctaataaaggcctgatttatgaaatgaatgaaaacagagctagtttggttgaactggacttggggtgggtgctttggctacacacctactcaaatccacctcttctctcgacttctctctctctgcagctctttcttgggttctgtggtggaactttctgggctgtgaagcaatgctgttgaaaggccatttggtattagggactcctgtttgtggctcctgggatgaggtggttatgattttg

SEQ ID NO: 694 - DNA, 1502 bp, Homo sapiens
gctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcataaaaaaaaaaaaaaaaaaaaaaaaaaaaaaaaaaaactcgag

SEQ ID NO: 695 - DNA, 3308 bp, Homo sapiens
ccacgcgtccggcccagggctgtctgtctccaaagcccaaccataactcacatccccattccagctcctctgggtgagtctgttccccctcagcctcactttccttatcctgtcaaatgaaggatttggaatgacttaagttattcaagcaacaaacacttactgaattgtcttgccacttccagggtgacattatggagttctgtgattctgcaagaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcaggacaagtgtccagactgcatggccagcctaattgtggcgagacaaggccttggggacatggcagtctccaacaccatagaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgtcctcctctcccctccttcccccaccacaggtctctcctgcataggcagccactgtccgttctttcacacactggaaggaagagccatcgtggtctttgtctggccacagccaagctgctgggcatcctcctcctccttggagttccacccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcacccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaagagacaggatctcgctgtgttccccaggtaggtcttgaactcctggcctcaagtgatcctcctgccttgacctcccaaagtgctggattacaagcgtgagcccctgcacccggcccaagcagttgcttctttttttctctttttttttttttttgagatggagcctcactctgttgcccaggctggagtgcagtggcgcgatctccactcactgcaagctccgcctcccgggttcatgccattctcctgcctcagcctcccgagtagctgggactacaggcgcctgccaccacacccagctaattttttgtatttttggtacagacagggtttcaccgtgttagccaggatggtcttgatctctgatctcggatccgccaccccggcctccaaagtgctggattacaagcgtgagccaccgggccccgccaagcagttgcttcttatgcaacatgttgggtgggacttgtccacgggccaggccaataaaattcttaatcctgcagagaggcagtaccctcatcaccccatcactggaaaacaaatgtttaagctatcaagagagggaatgtgcagcttggttctagatgcatggtttggaggatctacctttggcctaaagggaatgtcccaaacaacagagccttctttgctgtcactccagaattctctacacagaatttcccaagtccattcaggacagacgcgcagtcctctttcaatggaagaagagaggacttttcccctcctgaaaaatgactggagtgtgaacaaggcagctctgtttttctaaataagttgttcttgtgagttttttctggccactgggcatctctgccctcacttttcatccctgccctctaagctgcagaccccatgaccacactgtctgcttccttgagcttcccgcacgaggcttgcacctgggggacctggagaccctgcggacagaactgtggctgagccactgtggccaactcttggggagctccacagtgggggttgctggtctgtgaggctgagtctccatttcagagcacacactccctggcagggcgcctccgcctgtgtctcctgcccagcagccgccagcagggaatagttgctggtgtctgagcacaaagagagctttgattacctagagaggaaaaaggctgtcagccagatgcagccaggcccaggggtagatacaggagttgctaaggaaggggccgagccaggagaggccaggcagatccacaaagcccaaggggatgcaggctgggtgtggtttctgagggaacctaccaaatagcaggtagatggaatcagaggactcttgtgtcctgaaagaacctccttaaaaacaactaaaaccaagaacttctggggctgttcacacattgttcaagtcaccccaagatcgttctggcacgctgagctgaacaccaccatctttgttcattctctctctaatgggcaaagcaggatcatcgagttgaaaagttgtaaataatgaggatatttatcccgctatttattttttcaataactgtgacctcctgcactgtgaatgctctgtgacatgagattcttagtttaataaaactgtcattaaatttgaaaaaaaaaaaaaaaaaaaaaaaaaaaaaaaaaaaaaa

SEQ ID NO: 696 - DNA, 866 bp, Homo sapiens
ccacgcgtccgctccaaacaaacaaaaaatgaactttatttagatatattttacatatgatgaagtatttttttgatgtagtagtttttctcaccttctttttagtcttctctttatccatttttctttctgatgaagaattccctgtgagtaggacccagaacataggcctttgtcatttcaacccttcgttctctgaataggctgtttattggcaacattaactggaaacattttatgtacagcattggagtctcactctgtcgcctcagctcactgcaacctccgcctcctgggttcaagtgatgtgcactgtatgaactgtgagagcaagcatatcattataacattggacaatgagccaagacagttctgatggacttttgaagagggatttttcaaaagcatttaactcatcatattaataaaataaatcctatgatttatgggaaattctgttggatcaactttggaaactgtttactataaaggtagcatgcgtaggcatgaatcttgataagacaagattctgatccggggttctgagtgggtccttatattctgcagagctgaaccaggtggaataggaggagagtttgggtaacagtcaaacacaacatccaaaattatgttgaatgtagtggtgagagctattccctttaaaactctctcttggttcttctgactgtgtcaagaatactgtatttgtttggtactggtctggtttttttttttttttttttgaaatgcactccagcctgggcgacaagagtgaaactctgtctgaaaagaaagaaagaaagaaaaagaaagaaaggaaagaaggaaggaagaaaaaaaagaaaagaaagaaaaaaaaaaaaaaa

SEQ ID NO: 697 - DNA, 2950 bp, Homo sapiens
cccggctcccgcccgctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacacygacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcatctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccaggaaagggtagcacgtgcagctctcaccgcagatggggcctagaatcaggcttgcttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccrcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaaaaaaaaaaaaaaaaaaaaaaaaaaaaaaaaaaaaaag

SEQ ID NO: 698 - DNA, 1769 bp, Homo sapiens
agaaaaattgcagggacccaccccagacttgtgagtgcgagtgaagcaggagcagccctggccatcactgtttctttgacgtgtacatcccatcctgagatgcagctgggctgggagccgccacctgggtggatctgattcctggatttccccatcctggggasaggtgacccatcctgttctcctccttaggtccatgtgaaatctgargtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctaaaaaaaaaaaaaaaaaaaaaaaaaagggcggccgctctagaggatccctcgaggggcccaagcttaccgtgcatgcgacggtatagctctctcctatagtgagccta

SEQ ID NO: 699 - DNA, 1903 bp, Homo sapiens
saacaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggtgagttctcaacacctagaccatctgatatttttcttataatgtttccaggaagaggggggttcagtttctcaagtgattatgttagaaagccaactcctatagcacatctgaaatctgctacacctcacagattgttatgtgccagtgtgtacatatgtgtgtgtatgtgtgcgtttgaggtgagtgagatagaggagagtagagaaatagatagtaaaagttattgtttttgactttagggattataaaatttatttgataagtccaaaagtagaccactgaaatattgaaaaaattataaagtgaatacctatagttgcgaatagctctgtgattgcttgtccttctttgttgttttttttttctctttttcccatttttctcttctttacttttgttcattacaatttcttgaagttatgtttgtggtgcttaggcaattaaacacttcttaatagttcacagtttgtttagaggaaaaacagcaaacaactaactgacttcctagtgattttctgggaatattcagagcttcatctctcttccctgttccccgaaagaggcctttaatatgctttgacaactgaggaaggacagatagaagttaagcttggggaaaccaagctgaataaaacatgaaaaaatacatagggggggagtaggtaagagtaaaaaatacttggtttataaaaattttatagccaacatcatattcaatggtgaaaggcttagagctttccccctaagaacaggaacaagacatggatccttgcttttgccatttccatttaacattaaactgaaaattctagccagagcaaacaggcaagaacaagaaataaaagatatctaacttagaaaaaaagaagtaaaactttattcacagatggcatgaacttatgtgtagaaaaattcttaaaaatttgtttaaaactattaaagctaatacatgaatttagcaattccacatgatacaggatcaacacacaaaaatcagtgatatttctatacactagcaataaacaatccacaaagaaaattaaggaaacagttccatttacaatagcatcaaaatgaataaaatatttaagtacaaatttaaccaaagaggtataagagttgtacactgaacaaagaaagcatggctgaaagaaattcaagaatatgtaaataaatgcaaagacattctgtattcatggactgaaagatgtaatattgtaaagatagcaatattccccaaggtgatctacagattcaatgcagttccactaaaatcctaacagctttttgttgctattgcagaaataaaaaagctgatcctaaaattcacattgagttgcaacagacccagaattgccaaaacaatcttgaaaaagaacaaaactgaagctaagacttccctatttcaaaacttactacaaaatgacagttaaaaaaaaaaaaaaa

SEQ ID NO: 700 - DNA, 3878 bp, Homo sapiens
  misc_feature (36)..(36): n equals a,t,g, or c
  misc_feature (61)..(61): n equals a,t,g, or c
  misc_feature (210)..(210): n equals a,t,g, or c
  misc_feature (271)..(271): n equals a,t,g, or c
  misc_feature (2410)..(2410): n equals a,t,g, or c
tccctaggtttgcgccttttgaataagtatcacttnttagttgctccatgcctcagtttgncatctgaaaatgggggcatctgtaatgcctgtgttatgaggagtaaattacaagcatccctgtaagacgtagcacagtgtcgagtacggaatgttatttccatccttctcacggagcttggttccccttccccatgccctttacttgtnccagccattgactcatactacttcccttcttgcaggcattggtccagtgctgggcctggtntgtgtcccgctcctaggctcagccagtgaccactggcgwggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggtaaggccttggcagccagcagaggctggtgtgggagccgcccaccagagacgacactcggggctgtgtctgggctggtgcctctccatcctggccccgacttctctgtcaggaaagtggggatggaccccatctgcatacacggcttctcatgggtgtggaacatctctgcttgcggtttcaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggtcagtggaagaacctagactcccattgctagaggtagaaaggggaagggtgctggggagcagggctggtccacagcaggtctcgtgcagcaggtacctgtggttccgccttctcatctccctgagactgctccgacccttccctcccaggctctgtctgatggcccctctccctctgcaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttmmgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgncaagagcgacttggcaaatactcagcgtagaaacttccagcmcattggggtgragggcctgcctcactgggtcccagctccctgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaaaaaaaaaaaaaaaaaaaaaagggcggccgctctagaggatccctcgaggggc

SEQ ID NO: 701 - DNA, 1317 bp, Homo sapiens
ccacgcgtccggacgccgccacctccggaacaagccatggtggcggctacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccacttcaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcacataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 702 - DNA, 1138 bp, Homo sapiens
ccacgcgtccgggcgcctgtagtcccagctattcaggaggccgaggcaggagaattgcctgaactcaggaggcggagttgcagtgagccgagatcgcgccattgcactccagcctgggtgacagagtgagactctttctcccaaaaaaaaaaaaaaaaaaaaagtcaaatgcagctgggaatgtggttcgtgcctttttgtatattaaccatttgaaacttggttgtaaggtggggttggcaatgtcaggcctggctgcagcagctcatgtctttagagtgtgcctcttccctctctcgtggggctcgagcaagactaccttcatacatgggctctccagttacatagcaactccagtgttaaattccatcttttcttcctggaaaagccgtagaaaggacacctggacatgcctgctgcacaggttgtctgccttccccatcagccgcagaaggaggaactttgctctcttctctcacagctgtgtgtgcataagaagtagttcggatgatgtgggtcccaccatgtattccttctctgttccatgtagagtaaaataaatgggagttctgtttaatgcatcacctcggttcatattgcatttgccaagaaagtgcaattttattgaacattaggattgaattcttaactgagtaatcaatttcagtagtaagttaaaatgccttctattaatggacaactgcaaccgttaatcagagttacagtagattaacagttgtcagcatttatgctaatagcactaataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctggtagcttagagtcgaaggcattggaaaaatgcaattaaaggatgcctagatgtaaacaaaaaaaaaaaaaaa

SEQ ID NO: 703 - DNA, 1841 bp, Homo sapiens
  misc_feature (1)..(1): n equals a,t,g, or c
ncccggcccgctgccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctgtggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtggaggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctctccccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcaccttgcctccctgcctacacgtctctgtggggagaaagtgatggggactactgtccaggagctgctgctcccctcgtgttacccacaggcacccatgcctttcccagtgcactgacagtgcgggccagtctgctgtccagcacggcccctggggctccctccagttggcctgctggcccgggatgtgactctgaggggacccatccctaatgaaacacagctctgagccctccaagggttgggcagtgggcggccccagaggaacttcaagtgggacaggagctgcaggtgctgcctctgctctctccttgagcctccctggcgcagaccactcccc

SEQ ID NO: 704 - DNA, 6729 bp, Homo sapiens
ccacgcgtccgggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccaacccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgtgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttccccttcatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaagtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcggagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgtgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagg

SEQ ID NO: 705 - DNA, 1133 bp, Homo sapiens
  misc_feature (1061)..(1061): n equals a,t,g, or c
  misc_feature (1078)..(1078): n equals a,t,g, or c
  misc_feature (1102)..(1102): n equals a,t,g, or c
  misc_feature (1107)..(1107): n equals a,t,g, or c
  misc_feature (1111)..(1111): n equals a,t,g, or c
ggggcggcgcgctccctgcctgctgctgggcggagggaaggcggcaagagctgcggagcccctggaagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcargarccagaatccgcctgcagacagcagctgagcccgctgctcggagctkattggagcctggacagcacccggtgtccgctggtctggaacgctgaagctntatcctcggaagtactnttgacagatcactttaccgaagtnatggncagngaacgacttcagagttacctgt

SEQ ID NO: 706 - DNA, 1677 bp, Homo sapiens
  misc_feature (537)..(537): n equals a,t,g, or c
ccccccgggtcgacccacgcgtccggactttttttattttagctattccagggggtttgaagtagtactgcattgtgattttaatttgcatttccctgatgattaatagtgataagcatattttcatataatatttaccatttatttatcttcttgtttgaaatatctgttcaagtcttatgcccattttaatgggacagtttttctgtttattattgattcatattattgacttatagtaatattttatgaattgatctctttattattatgaaatgyttctttttatttgtggtaatactcatcatcatgaaatctaatttgtctgatattattatagccacttatacttactgtatacctgattattttttccatacctttatcttcaatttatctgtatatttgaattcaaagttcatctcttgagcctgaaagtaataagcaccttgaacccggatctttatatctaaatatgattctccagtaaaatttatcagggttctctggacaagtggctgattgattgtagagcanggataagaagagtatatgctgaacctgaatcatttttgtggtgccaaaagtaaggaagtacacaaaaaaattgagaagatatcawgaaatgcacaaaaactaacctgaagtgactctyaatgaccatatctkggacaatttgagtaaaaaaataagtaacaataatggatgatatcttataagataatataaaacaaatatcaatgagtctatgatgatatagaattagaatgtataaatgggaggaaggggaaaattctttgcttaagcagaataataattaattaatataaaaagaataatggaaatggtagaaatagaaagtcaacatttggcaagcaccacagtaataattgttgcaggcaagaatcatcaatggatgctaaagtttgtgagaaaaagtttgatgagaaatgggctatttacataacctcaaaggcttttcccacaagatactgttaattacaaaggggaaaatattgagaaacatggaagacagcaccttaaccaaatgattgaagttaataccattagtaatgcaacaaatcagtatcgtgtgcctcctgatatgatgcactgagaagggcacaagcatcacctttatggtattcttgcaaaaaatgcataatctaaattcaaccatgaagaaatattagaaggatgttctatgactagtcagtactgctcaaaaatgtcaagattatgaaagacaaagaaagactaaggtactttccagatttaaagaaattaaatagacaggactactaaatgcaatatatgagtctgaattggaccctggactaaaattaggcagacagttggtgaattttgagtcaagtctgtagagtagttaatagtatttctggttttgatcatcataatatggttatttaagatgttaacatttggtggatctgggtgaaaagtatatgaggattctctcgcagtatttttgcaatttttttaaatctgaaattcttttaaaatgagaagttggctgggcacagtggctcacacctgtaatcccagcactttgaaacaccaaggcaggagactcgcttgagcccaggagtttgagaccatcctgcgtaagatggcaagactccatctctttaaaaaaaaaaaaaaaagggcggccgc

SEQ ID NO: 707 - DNA, 753 bp, Homo sapiens
cccacgcgtccgactgcttatatttggcattgtcttttccctggcactgccactgtcaccaccatcccccttctggatccctactttaccccttcatgctgctctggtggcagtgcctctgctgccatgctgtacttgagcctgctgctacagccatgcctgaagatgcagccccttcctctcttcctgtcccaccaaatatgaccagctctaggttccattacttctggactttgctccaaataaaacttacacaattttattccaaacccaggtctctttctgcaacacccgagaaaaatattgggctgcaggagccagagaggagagagagatttactggtgagagttgtaggtgggaattgaaaagccaagtcatgtctttgccccaccagaaactcactaggatgtacacaatgccactgtgatggttttaaaatatgtaactaacctgcacgttgtgcacatgtaccctaaaacttcaagtatatataaaaaaagaaagaactgctgatacacatatcatgaaaaaagaccaaataaaataaaaaaataaaaataaataaataaaataaaatatgtccacaaatgctttgatgttcctttgtttcttgatctgtatgctagcaacacaggttcattccgtttgtgaaaattcattgagctgtgctcttatgagctgtgtacttctctacatgtatgttaaatgtggacaagaacttcacataaaaatcattttaaaaaaaaaaaaaa

SEQ ID NO: 708 - DNA, 1604 bp, Homo sapiens
ccacgcgtccggcagacacaggcacttattcattcatctcattgaaaagctacgagttggttccttattgcctctccataatagaaaaactctttaatgagctctctttttgtttttcaaatcagatatgcaaagaagctcataacaattttttttaaaaatgcaaaacaagaatctccaattatgggagcaaaatcttcagcttctgggttcctgtctcactgaggaaatggatttgaaatggcaaggaggaaatgaggaggcaaactttcatgtctattttagttttccaatgcagtcctatttcctttggactttgtataaacaaggaaaggacagttgttagttcagttattacagataacctgtgtctttaaagtaaatgtatcttaaataagtaggactcccataaatgactacactttttcaaaatatgactccccagcttataacaagaataatagcaaacatcactttattaagcaattactatgtaaaagacacttagtgcttagcacacactggaaatattgttgactggctatattttccccagaaatcccatttctgaaagcctattacaaagaaataaaatcatcagtataacaaaggagtgtgtgtgtgtgtgggtgtgagtgtgtgtgggtgtgagtgtgtggggggtgtgagtgtgtgtgggtgtgagagtgtgtgtgtgagtgtgagtgtgtgtgtgtgtaagtgcacacacatgttgtagtattgttcatagtggcaaaaactagaaacaaagtgaatattgataacatgggcacagatgacaaattatatctccaaattatgaaacagaatccagccattaaaatcagagctttgccacgtgactaggatgaagttacaaaaagtattgttgagtgagaaaagcaggatacataggatacatggaattgagtataatatgatttctttttttttttttttgagatggagtctcgctctgtcactcaggctggagtgcagtggcacaatctcagctcactgcaacctccgcctcccggattcaagcaattctcctccctcagcctcctgagtagctgggactaccgtcacctgccaccacgccccagctaatttttgtatttttagtagagatgggctttcaccatattggtcacgctgatctcaaaatcctgacctcaggtgatccacctgcctcagcctcccaaagtgctgggattacagtcgtgagccactgcacctggccgatttcttttttaaaatgatcaaaaaaccatttatatgtgggaatatagctatatacttttattattgaattaccatggaaaaaaacatggaagagggaggccaaggcaggagaatcacttgaggcccaggagtttgagaccagcctgggcaacaaagcgagaccctcatctctactaaaaatacaaaaattacctgggcctggtgacacatgcctgtaatcccagctactcagaagactaaggcaagtgaatcgcttgaacccgagacgtggaggttgcagtgaagtgagccaagatcgcgccgttgcactccagcctggtgacagagtgagagtctttctcaaaaaaaaaaaaaaaaaa

SEQ ID NO: 709 - DNA, 1021 bp, Homo sapiens
ccacgcgtccggataggcacaggacaggagtaggcacctcgcctactgctgcttaacctttcagcttctccaggcccccaatcctgcttgctcccagcttgggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgcccttcctggcgcctcggctgcgcagcccggcctggcccgccgctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggg

SEQ ID NO: 710 - DNA, 985 bp, Homo sapiens
  misc_feature (1)..(1): n equals a,t,g, or c
nagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagctgtgcatttggatcagctgctatttggcaatacgaatcactgaaatccaggggtccagagttattttgatggcataaaagctgattggttggatagcataagaccacaaaaagaaggagacttcagaaaggagattaacaagcggtggaataacctaagtgatggccagcggactcaggtatcatagctgcaaacgtccttgtattctgtttgtggagagtaccttctctgcagtggacagtgatctgatatttcaaatcttatccagcctccaaaagt

SEQ ID NO: 711 - DNA, 1445 bp, Homo sapiens
ggaaggctgcaggaccaggaccgaaaaaggactaggaggctgggatcagcaacaactggggaaggccaaggaagactgacctgaggggaaaggagaaactggggaggtgaggtctactactcaacaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccacagaccccgaaaaaaaaaaaaaaaaagggcggccgc

SEQ ID NO: 712 - DNA, 1699 bp, Homo sapiens
acgcgtccgcgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtaaaaaaaaaaaaaaaaaaaaaaaaaaaaaaaaaaaaaaaaaaaaaaaaaaaaaaaaaaaaaaaaaaaa

SEQ ID NO: 713 - DNA, 1529 bp, Homo sapiens
  misc_feature (1505)..(1505): n equals a,t,g, or c
gcggttgccgccgccgccgatcagctgagcwgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatkttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcstttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaaaaaaaaaaaaagggcggccgctctagaggatccckcgaggggcccaagcgtttccngtargttccccttaaagacccccg

SEQ ID NO: 714 - DNA, 1218 bp, Homo sapiens
ccacgcgtccgatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaaaaaaaaaaaaaaaagg

SEQ ID NO: 715 - DNA, 831 bp, Homo sapiens
  misc_feature (5)..(5): n equals a,t,g, or c
  misc_feature (10)..(11): n equals a,t,g, or c
  misc_feature (15)..(15): n equals a,t,g, or c
  misc_feature (27)..(27): n equals a,t,g, or c
catcnacggnnaccnctactataggtnaagctggtacgcctgcaggtaccggtccggaattcccgggtcgacccacgcgtccgggggaawtcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataakgcaaggcacatagcagggaaacccattcttgataacaacgcagtgaatctgttttcttctgttcttattgccctcttgctcccaactgctgcttggggtttttggcccagggggtgaactttatttcatttccmcaggttgaaactgaatgggcagttcatgktaaaatcmcttttcatggaaagagctctatgtaacagcataataaaactgsctacctagcagcaaaaaaaaaaaaaaaaaaaaaaaaaaaaaaaaaaaaaaaagggcggccgctctagaggatccaagcttacgtacgcgtgcatgcgacatcatagct

SEQ ID NO: 716 - DNA, 637 bp, Homo sapiens
gattttcctgcttgcatcatttctagcacagagctggaggaaatggcgaggtgcaggtggccgctggccmtgctgttctacatgggagcaagacagctgctaggtgaaggggaatgaccaggcagccacagggaggacatgtggcctcaggaagcctgggtgtgtatcctggttctgctaggaacacgtgtggggctttgtgtgggtgactctctggctccccaagcctccctttcctactgttatatccttaaagtgcctctgaggccaaagcctttgtggcaattgtcaaatgagtccatatgcagtgagtaccgtgttgagggaggacaaggtcaccaagagctgagaatgtttctccgactgatgagacctagatattgggtacatggaggtccccggtccctttgtgattcctgcagcctgttgcctccttgcctggaccccgcctcagctcagaaagccaattccctagattccaaaggccttcccagaccaattagcatgtcctgcagctgtcagctccctgtgcctagcctggacctcagctcatgtctagcacccagtctcccaaccccacacatattcacaaataaaagaaaataacaaatgaaaaaaaaaaaaaaaaaaaaaaaat

SEQ ID NO: 717 - DNA, 3337 bp, Homo sapiens
ggttgatttcccctcaactttccacaggtatcttaaaagctttgctcactcatcccttctctgacttaggatttgagcatctttctgttatgctgttgccccactcctattgcaatactcctcttcttaagaaagtttttctagactaatgtctagattaaacttcttttctttgacaataatgatgccatgacttggacaaaatgcccattgcctctgggtcctgctttcttcacccagtgctgccttattggactccttgtgcctctccttggctggggaaatcagaatacacagtggtatcccacttctaagatgcctgatctgaaggacagtaaaacaactgacctttgccagcatgtaaaacacatggtttaactagtcctccaggaacaacamtgagcaatcctgacctgggactactttactcggccatctcctacttgagatgctccttgtctctctgttcaaggacaccttttctgagcctttcttgaacaagagtggaggaccgataggcgattaaactgtccttgacacaactttagagcttcwactgagaatctagaagagagtagatggaaaaatatttttccctcccctccaaatgcaaggataatcttacacgagtccaggaggaaggctcattccacactaagtgttctgaatcaaaaagatgaacaaaatacagtgccattcttcaaggrcttcacagtctacaggaaagggwtatagttaaacaaataactgcagaattggaaattggagctgatgtgcttagaagtgttttgaacaaggggcatgactgtgactctctctgcttttgcaagcttcaggaaaacctttactcacagttgaaaatacagagcctcagggtgaagccctaacttcccacagcagatggggtctatgaggaggaagaagtagacgcatggaccagtcctgttatgaagacaagtttcatggtgctactgtgtctccatgagctcctatggcccagaagctggcatcctgtgagtggacggagtcttgctcggtcgcccaggctggagtgcagttaaatgaaaaaacgtacccagacagaggttctaaaacagcaccaaaatattaatttaatgagtggagawtagttttctttatcaacactacaattttcttttctttttttttttttttttttttttgagacgtagtctcactctgtcgctcaggctggagtgcagtggcacaatctcggctcactgcaagctccgcctcccgggttcacaccattctcctgcctcagcctcccaagtagctgggactacaggtgcccaccaccacgcccagctaatgttctgtatttttagtagagatggggtttcactgtgttatctaggatggctcgatctcctgacctcgtgatctgcccgctcggcctcccaaagtgctggaattacaggtgtgagccacattgcccggcccatttatgktgkttttatccatctaaccagccaccatatattgtgtgcttcccatgtaccacaacacattctgagaacttgccacacatgctctactttcgtcttcacatcaacaatgtgaatcttaagctgtgctgaattttgtccaaaatgactcagataggaaaaggcagaataaggaatacattccagttgtctccaaagtccacccttttctaagtgtcacattatattgtccttgccactggcacacagcttaaataaaagtcaaaccatgagaagccatagaaagtaatatcagagtacaggtgagaagttgcacttacataaatgatcattcaagacttcctggagaaggcacgagttgtcctttggagtgaccaagactcacttccaagtagaaagctcagtaattttgcttgagagatagcatggaaagggcccagtcttcagagtgtggctgacttgaatttgagctctatcttcatctattrctacccatgtgcctctggacatcttacttaacctctctgaatcttcatcttgtcattgtgagaaacctgattgacttgttgtaaagattaaagaaatcatgaaacacatctagtccaaaactgatactatagtagacatttaacaagtgatgtttgatttaattcaagtctctaggttatagtaagacaatggcaaaatattaattaatcagcttctccagtttgtgcgtttgagaagggtaagccaaaggaggactttgttttcatatctcatattgcatcgtttgtcataaaaattacacatttatacaagcgcgcacacacacacacacacacaggcacaaacactcagacatgagccacaatccacaatgaaggagtgcttagagtgcttaggcaccataataaactttcacataaagtacagcagtagcattcttaattaaaatctctaaagtactcttgttgttgacaatatcrccacccaaagccatatttaccttgttaattattcaagttgcagtgaataagaaacaatgcccaggcttcccataaaatttccaaaaattaaaccagggaaatgggcaataaatgtcatttgaaatggaactgatgccagttaattacaagacaactgtaaaataatggggcatgaggttcttcaacaatgcctaattagtaactatatgggcatttccttggaaaaaatggcaattacacggtgcaaacacttagcagtcatcatcaaaggcccttaaccaatattagctaattaatcttccctacaacactccagcaggaggcagcacaagtcctcattgagggagggagaakggaagccaaaagatgaaatggaaaatcctcttctgctcagcatctgtaaagaacaatttgacactcgcagcctagaagcactcaggagggattcccagrccaagagagagagttttccttaatgataaggttaatgtggtgaacacctagcttcctcctgatttgctgccatggctcacatccttgctgtccycgagaactccccacaccaaattgctgttgcaggcacacatgcactcttgcgcttatcaacccttttctctttttctcagcaagaaggcttttgacctcaaatatataaaaccaatggggggagaaggaagctatgcctctttccacaaagccaagcttgttatattataacatgatccacagcttttgatttcaacttaatgtatgagatctggaattatttcagaagtatgattgattttgatcaggtgaagatattttaaaagaagtgaattatctcttatgttacttaatttaatccacattaaagatttatgacaaaaaaaaaaaaaaaaaaaaaaaaagggcggccgc

SEQ ID NO: 718 - DNA, 1440 bp, Homo sapiens
  misc_feature (323)..(323): n equals a,t,g, or c
  misc_feature (337)..(337): n equals a,t,g, or c
gcttccacacagtatgacagacctctagactagaagtacatgatgaaaatagttggtaattaagataaaattgatttaatttactttagtcctgaacattgaatacttgtcaggatgccattgcaataatggcatatatcggagccaaatggtcaaatgatacacagagccaggagcctagcagccttgtccagtttgatgctctataccaagcttgtccaaccagtggcctgcatatcacatgtggcccaggacggctttgaatatggcccaacacaaattcataaactttcttaaaacaatatgagcttatgaaattttyntcatgatatttttncttttttcttttttttttttttttaactcatyagctatcattagtgttaatgtattttatgtgtggcccaagacagttcttccaatgtggcccaggaaagccaaaagattggacacccctgctttataccctttacactgtcctcggtagagaaaaaaaaaatgcttcaaagaatcgctaattttaaagaagagtagatgataaaagttaccaaaacaaaccgaaaaatttattgtatttgggattttagaaaatccaactattaggaaccagaatttagtctgctacagtaggaaaacaatgtgaatattcacatcatcaagttgatgttacataaccttagaaagctactgctgaatcttttatatcaatggattctatttttaaatacttttcataataatcattattttatgacatgactataatattaaatctgttaggactagaagaatttttacctttttcaaggaaattgttagtagttcagcaaacagtttctactctgtgacataagcccaggaaagtgaagtctcttgaaaactttttttctctaaccttcattcttgatggcaagcaactatgtgcttagaacgatggttttcaactttggttgcaccttaactctgaaacttaaaaaaaagataccccctgagattctgatttaattggtgtggagtataatctgggccttgataggggtcagagctcttcaggtgattctaatgtgcatccgtgattgagaattgctagttaagaagctgtttaatgtccttaaagaagaaactaatttttctttctcggagttgtattcatcttcaacagatattacwtagtcataagagaaaaatataaaatcaggaaaagcgtatatagagttatgaaagaggggttatgaattataaacagttttatgattaagtccaatcgtttaattgttattgaaagatagtcttatatttttaagtcctattttgctatttaacccttgtttatacttttgttcagtgctttgctctcctggtgtcaccttcataataataattcaactttgatcaataaaataaacaatcttctggaaaaaaaaaaaaaaaaaactcgta

SEQ ID NO: 719 - DNA, 888 bp, Homo sapiens
gcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgttttactgaacttatggaaaattgaaccaagt

SEQ ID NO: 720 - DNA, 1734 bp, Homo sapiens
  misc_feature (1714)..(1714): n equals a,t,g, or c
  misc_feature (1719)..(1719): n equals a,t,g, or c
  misc_feature (1723)..(1723): n equals a,t,g, or c
gcgggagttcctccttgctctcgcccctactctttctggtgttagatcgagcwaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaaaaagggggggccgcnctggngggnccaagctttcg

SEQ ID NO: 721 - DNA, 2534 bp, Homo sapiens
cccgggtcgacccacgcgtccgggacgcgccgtggacccgcgtgcggacggcggggacaggctccggtgctgagcgcctccggtgtccccagcagcactgacccacttgcaggccccggagctgagccgccagccatggccgctccccgcgggagggccgcgccctggacgacggccctgctgctgctcctagcctcgcaggtcctgtctccgggaagctgcgcggacgaggaggaggtccccgaggagtgggtgctcctgcacgtcgtccagggccagataggcgccgggaactacagctacctgcggctgaaccacgagggcaagatagtcctcaggatgcgcagcctcaagggagatgcggatctgtacgtctccgccagcagcctgcaccccagcttcgacgactacgagctgcaatcggccacctgcggcccggacgccgtgtccatccccgcgcacttccggcgcccagtgggcatcggcgtctatggacacccctcccacctggagagcgagttcgagatgaaggtgtactacgacggcacggtcgagcagcacccgttcggcgaggccgcctaccccgccgacggcgcagatgccggccagaagcacgctggtgccccggaagacgcctcgcaagaggaggaatctgttctctggacgatattaattagcattttgaaactggaacttgaaattctcttttgagtcgttgaccacactctgggatataaaaccctccatctgtgaagctgattgcagtttgctgtgaaccttgctacttgtacttggttgaagttctaggtacctttagtcaagggatggaaaaataaagccatacgcagttttgttacctcagttaccccaaaaataggaaaagcagcaagcacagtattttaaagatcataattcctataaaaggactgtgcacaaagtgtttagactccattttcattaggcaggttgactaaaaatgattgcagtaacaggtttatataaaatagagcaacctttcatgctgtgacacaaatcaaaaggttgataactttgtaattttactctggagattctaaccgaagttggtgtaagttttcaagagttactaaaatcaagttggaaatgatttacgtacacttccctgagcctggactaaagcctcatgcctgtaccccaagtaggtgatggtacttttctatacaaaaaggatttcctggcaggcaggtatttacaaagtttgttcctgtaccagtccaataatgacaactctaaatccagctgcaccaaatcttagtgggccatttgtcatacctatgaaaattcttcagttattaaataactttgtcagtgctacctatggtaggccggaaacaatgtagattaggaagtttcatgaaaattaacttttggggctatggagaaacagttaagtatcttaagttactaaacatttccactgaatttttggagtgagccaaggttactataaaatactttggaagatgaattctctacctggagttagtttcgagagtaagcgtagcttttaacagaaataactgcagattttaagctaataatttgcaaaaaaaatcttttattggcatgaaaataatgttgtaaatggcaccaaatattccacttaaatgcatatacagtattagagtcaaaaactattttatccctctttgctgtttttcccccttctgcccactttcctgggtgttgggggggcccgctgacaacagtcacaaatccagcgacctaggaaaaaaattgttaatatagaatgaaaaattatctttacaggactgaattttaagcccatctaaactcttctgccttagctatcactaatgatattcctctctggattttgtggtgagaagggcactatgagttccttaatttaaggaaaaaatgtaaacttaatcaatgtaatcaatgccatgcaaaattcattgcaagtcaagggggatgggagagatgcaatgccatacggtgatacggacctttaagaaagtacaatctttcctgaaattcaaacactatcatacttcaaaaggtcaaaacccattccggaaattggcttttttaagactttttctctcctgctcactggcagctgtgtgtcttaacagcattctttcaagtcctggtgtactctgctgacagcactttaaaactttaacagcacaatgataacttgtactacatacttgatctgaattactacagaaaaataattatgttgcttgcttaatgattcccaggaaacttcgttgtaggcatatattttataagagtattatacagtgttaactatgcaagtaagttctaaaattacacaattatctgtgtaatgttttagtccaattactgtgatttattcaactctgttctaaagttatctggaattgtcatgctgcctcaatttacagaaatctataatagatttctatagaaatgtaaaaaaaaaaaaaaaaaaaaaaaaaaaaaaaaaaaaaaaaaaaaaaaaaaaaggaaaaaaaaaa

SEQ ID NO: 722 - DNA, 1163 bp, Homo sapiens
tgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggagtctcgctgtgtcacccaggctggagtgcagtggtgtgatcttggcttactgcaacctctgcctcccaggttcaagtgattctcctgcctcagcctcccaagtacctgggactacagatctttagataagcactctttcaaccaaatgccaatcagaaaatctttgaatccacctgtgagctggaagccccgctgtgctttgtgttgtcctgccttttcggaccaatgtaaatctcacatgtactgattgatgcctacatctccttaaaacgtataaaatcaagctgtaacccaaaaaaaaaaaaaaaaaa

SEQ ID NO: 723 - DNA, 1355 bp, Homo sapiens
ggagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggtaaggctctattttctcaagtttcaaagttcagttcatcttccagcagggatacaactatcccagtttgtactacaactgggttacccaggacatgggatttactgggaaagtctgggcaatctaggattatcgctcaccctaaatcaactaagaagattatgtatttctatctgaatcaagaaaaataaagattttactaaaaaaaaaaaaaaaaaaaaaaaaaaaaaaa

SEQ ID NO: 724 - DNA, 537 bp, Homo sapiens
gtccgggggacgtgcacggggccgccctcctggccctgaagctgcgccggcctccctgagcgtttcgctgcggagggaagtccactctcggggagagatgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccagaggcacccggtacagatacgtgtcccaagcacagcccaggggaaagccacgccaggacacggccaagagtccccaccgcaccaagttcaccctgtccctcgacgtccccaccaacatcatgaacctcctcttcaacatcgccaaggccaagaacctgcgtgcccaggc

SEQ ID NO: 725 - DNA, 2008 bp, Homo sapiens
cccccgggctgcaggaattcgcaacatcgtccttactcctgcatttttctgacgggcatgctcccacgcagcttgcgcaacaccaagcgggcggtcaaactctcggctcaattgttataagatcacataacaaaactttcatcctggagctctctcatgcgccgtttgctgctcgctttgccgtttgccctgctgccactggctgtcgctcatgctcacgaagaccatgaccacgagcacggcagcctcggcgcccatgaacatggcgtcgggcgcctgaatgccgtgctggacggccaggccctggagctggaactggacagcccggccatgaacctggtgggtttcgagcatgtagccaccagcgccgccgacaaagccaaggtcgccgccgtgcgcaaacagctggaaaatccatcggccctgttcaacctgcccaaggccgcaggttgtgtggtcagcagccaggaactcaacagcccgttgttcggtgacaaaccggaagccgagcatgacgacgatgaccacgcctccgacggcaaaggcgccgccgcccacaagcatgatcacgaccacagtgaaatccacgcccattaccagttcacctgcgccacaccgacagccctgggcaacctggacttgagccaggtgttcaagaccttccccgccacccagaaaattcaggtacaactgatcggcccgagcggtcagcaaggtgttgacgcaacggcaaccgcagccacgctgaagttctgatttgaaacaaggtccatgtgagagctggcttgcctgcgatacaggcgaggcggtgcagcaggcacactgccggatgccatcgcaggcaagccagctcccacagtggatcggcgccattttcgactaccaggcgacactgacttcccatgactcaagcgttaatcgaactgtccgacctgggcttcaactggcccggtcacccgcagttgctggacattcccgcgttccgcctggaacccggggaaaccttgttcctcaagggcccgagcggcagtggcaagaccactttgctggggctgctgggcggcgtgcagaagcccagccagggcagcattcgcctgctcggccaagagttgaccgaactctcggccggcgcccgtgaccgtttccgtgtggaccacaccggctatatcttccagcagttcaacctgctgccgtttctgtcggtacgcgagaacgtcgagttgccctgccacttttccaagctgcgcgcgcaacgggccaagcagcgtcacggcagcgtcgaccaggccgctgcgaccttgctcgcacacctgggtttgaaggacccgagcctgctggaacgccgtgccgattcgctgtccatcggccaacaacaacgggtggccgctgcccgagcgctgatcggccagccggagctggtgatcgccgacgagcccacctcggccctggactacgacgcccgcgaagccttcctgcagttgctgttcgccgaatgccgcgaagcgggcgccagcctgttgtttgtcagccatgaccagagcctggcgtcgctgttcgaccgcaacctgtcgctggccgaactcaatcgcgccgccatgcccgcagaggtttgagatgtatctgttccgtctagccatggccagcctggctaaccgccgctttaccgcgatcctcaccgcgtttgccatcgcgctttccgtctgcttgctgctcgcggtggagcgtgtgcgcgtcgaggcgcgcaacagtttcgccagcaccatcagcggcaccgacctgatcgtcggcgcccgttccggctcggtcaacctgctgctgtactcggtgttccgcatcggcaacgccaccaacaacatccgttgggacagctacgagcacttcgccgcgagccctcaagtgaaatgggcgatcccgatttcccttggcgattcccatcgcggctaccgggtgatgggcaccaacgaatcctacttcgagcactaccagtacgggcgcaagcaaaatctcg

SEQ ID NO: 726 - DNA, 1160 bp, Homo sapiens
  misc_feature (325)..(325): n equals a,t,g, or c
ggtcctatgtgtctataacttatcagattgggagctagcagaaagagataagattattgctatataatttttagggatagacaatttaatttccttggtttcctgtctcatggacctcacttaaccagtagtatgtgggtgttttttctaccttttttctccatcttatttaaaatttgttggtgtatttcccttagtcaaactaaagagaaacaatcatctaatcttatgttttatttcttttgtatatgtacatatgagaggaggaggaagaaagagatgaggagaggtgaaaagaaaagatccttctgcctgattgggcttngccagcatatgatagcagtgcaggcctggttccatgagcagcatcagattcaaatttcatagaaaaagagcccagaggaattgaaaaagagaaattaaattcaacaaggagaggcattgtatacattatgcattcacgataggttatgattgagaagaagctggtgctttgggaaaaacatattaggttctacatttaccctttttgaatagttttctcctttctaaacagggtgataataggagaatgctgaatgcctctccattgaatttggaaactgccgggccagcattagtgtggtattgtctgcccacacttttctagatgcaagtttaagatcatgttcagtgtgaacattgaggactttagagatcggagtccgaaatgtgtcaaagttaatgttaatagatgctgtcctcattttgtaactgtgacttctaaatgtgaccttttagttcatatctcataaatttgccatttaagaagaaatacagawatgaaagtttkaagttttaataaaagtatatcttgctgggtgcagtggctcatgcctataatcccagcactttgggaggccaaggccggcagatcacttgaggtcaggarttggaractagcctggccaacatggcaaaaccttgtctctactaaagatacaaaaaaaataggtgggcatggtggtgcacatccgtattcctagctacttggaaggctgaggcacaagaatcgcttgaacccgggagacagaggttgcagtgagccgtgattgcaccagtgcactccaacctgggtgacacagtgagactgattcaaaaaaaaaaaaaaaaaactcgag

SEQ ID NO: 727 - DNA, 2229 bp, Homo sapiens
  misc_feature (2227)..(2227): n equals a,t,g, or c
ggcagtatataaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaaaaaaaaaaaaaaaaaaaaaaaaaaaaaaaaaaaaaaaaancg

SEQ ID NO: 728 - DNA, 1016 bp, Homo sapiens
taattcggcagagccagcctgggtgcctgtatgcgctcgaggcgggggcgcgggttgcggacggaggcgcgggaggcggttctgcgcggcgggggccgtacccgcggcggagcgaggaggcgagaatggatcaatggtgtcacggagcacatcgctgacgctgattgtgttccttttccacagattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccataaaaaaaaaaaaaaaaaaaaaaaaaactcgtag

SEQ ID NO: 729 - DNA, 1430 bp, Homo sapiens
cggcacgaggagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggagggtaagtactcttttcctgctattatcctacactctcagttcctacaatttgcagagaatttttttttatataaagacataaaatcgtgaattataatccaaaaactaaggtaagaaactcctcatctcccttgaaaggcccaaaacttatcattggccttttatttctgcataatgtttggggattatataggtggggaaagttattacattatttgagatggctgtttcgatcatattcacagtgaatgtagttgttcagtgtatttttttgcaagttctgtactaacacgatgatgtatgtctttgtagtgcttatgttcaaaagctgttaccggctgtgtgctgtggctcatgcctgtagtcccagcactttgggaggccaacgcgggtggatcacttgaggtcagaagttcaagaccagcctggccaacctggtgaaaccccatctcaactagaaatacaaaaattagccaggcatggtggtgcatggctgtggtcacagctactcaggaggctgaggcgggagaattgtttgagccctggaggtggaggttgcagtgagccaagatcatgccactgcactccagcctgggtgacggggcgagactctgtctcaaaaaaaaaaaaaaaaaaaaaaaaaactcgag

SEQ ID NO: 730 - DNA, 1089 bp, Homo sapiens
  misc_feature (353)..(353): n equals a,t,g, or c
  misc_feature (528)..(528): n equals a,t,g, or c
cggcacgagaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatnccttccaacccatgagtgggcggtttaaagaccgggtgtcttgggatgggaatcctgagcggtacgatgcctccatccttctctggaaactgcagttcgacgacaatgggacatacacctgccaggtgaagaacccacctgatgttgatggggtgataggggacatccggctcancgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttaaaaaaaaaaaaaaaaaaaaaaaaaaaaaaaaaaaaaaaaaaaaaaaaaaaaaaaaaaaaaaaaaaaaaaaaaaaaa

SEQ ID NO: 731 - DNA, 2184 bp, Homo sapiens
ccacgcgtccgggcctgcctctccactcagagggacatcagctcaagagcaatcacacaaccccagagaagaaatccaaacctcaccttctgttgctgcttctctactatcttatgggtgcttgactggctctcccaagcctgctgtcctgcagcctcactgcctgtgtccttttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggcctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccttttcccttccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttggtccaaaaaaaaaaaaaaaaaaaaaaaaaaaaaaaa

SEQ ID NO: 732 - DNA, 1057 bp, Homo sapiens
tcgacccacgcgtccgctgagattacaggtgtgagccaccaggctcagccccctaagatttgaaacactttaaatggcccatggtagggttcctgctaggataaaacattaagcggctgttaaaagaaataaaaggaggacacgtctctgtgcactggtgtggacaaatctccaagtcactgcaaaatggaaaaagtataagatgctctttccctgaacctcaagggtcccgcccctctcactttcaggtctctggacctctgactgacactgtgcctgcccaggtccctgtatgcactgccacagtgccctgggccccatgtccacccctgtcctgcccttctctgggatagggctggccttcctctgcctctgcctggctgcatccatggtcgatctcaagtgccttggcatgaactccactctcctgcagccttcaatcaaggaatgatggggatgtgtacataccccaccccaccccttggcagggtgatgctgaggtgtggatttttaacagttcccagactttcccaggaggcttgggtttgggtgcccacagtgggagctggtgtgatatcataccttcgccggccgcctttccttcctgttctctgtgcccctactcccactctagagctgccccgtttctctgttttcgtgaaagagctgaccctgtgctgcctcccactctcccaatgcccctgccactcctgtgagcctgctgctggtgaggtcggtgctgacctctgtgttgctggataatgagtcatctatctctggaggagaagaaaggcaggtcctccacagccctgataaaatctccaagtctcccagtttcgggtccctctcctgggatgcagacccactgcctgcccagctggtacgatccacatgccctcttcttgggaataggggcatgggaaagtgactaaagatactgttctggctgctgtgttcactgtgagtaataaactgtccatttctccgaaaaaaaaaaaaaaaaaaaaaaaaaaaaaaaaaaaaaaaaaaaaaaaaaaaaaaaaaaaagggcggccgc

SEQ ID NO: 733 - DNA, 2803 bp, Homo sapiens
cccacgcgtccgcgacccacgcgtccggggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttatgagtggttctttcacgtgttgtgtccatagctttagtcttcctaaataagatccacccacacctaagtcacagaatttctaagttccccaactactctcacacccttttaaagataaagtatgttgtaaccaaaaaaaaaaaaaaaaaaaaaaaaaaaaaaaaaaaaaaaaaaaaaaaaa

SEQ ID NO: 734 - DNA, 370 bp, Homo sapiens
ggcacgagttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttaaaaaaaaaaaaaaaaaaa

SEQ ID NO: 735 - DNA, 1021 bp, Homo sapiens
gcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggkatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcamctgctgccctggaatcagccttttcctcctattcagacctcagcgarggcgaacaagaggctcgctttgcagcaggagtggctgagcagtttgccatcgcggaagccaagctccgagcatggtcttcggtggatggcgaggactccactgatgactcctatgatgaggactttgctgggggaatggacacaggtgagggacatcctgggctagggctgtggtggacccacctgatagaccttggcattctttcagagccacatccagaacactctcagcctttgcaaggggagggagagggacagactcagtccaggcaggcctggacactccagggacaggaaggctgtccacactcatgggtgggaaatgagcagacagaaatggattcgttcctttcccacaggtgctgaggcttctctgcctgtctgcacagttgtgccttgcagtcctcaaaaaaaaaaaaaaaaaaaaaactcga

SEQ ID NO: 736 - DNA, 1323 bp, Homo sapiens
  misc_feature (1086)..(1087): n equals a,t,g, or c
gctgaagatggggtccctcgcacggcacggtccatgtccctcacgctgggaaagaatatgcctcgccggaggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctgggaggagcttagtcaggagaccaaggccaggatggaggaagaagcctacagcaagggattccaagaaggtytaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagccccagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggnncagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaaaaaaaactcga

SEQ ID NO: 737 - DNA, 1408 bp, Homo sapiens
acgcgtccggcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgagtttgaaggaagaggtccctagctctgttccccctgagcctcttggggagtgggcaacatggtcccaatgactggggcggggaggggggaaggatccctaggctgagagtctagcctaggctgggagtctagcctgcacctgacttgctttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattgctagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaaaaaaaaaaaaaaaaaaaaaaaaaaaaaaaaaaaaaaaaaaaaaaaaaaaaaaaaaaaaaaaaaaaaa

SEQ ID NO: 738 - DNA, 541 bp, Homo sapiens
tgcaggtaaccgttccggaattcccgggttcgacccaaggggtcccgtgatgccttgtcatggtcttcttgcacagggcctcagcctggcacctctgccaccgtgggctctctgttgtgtgggggtgtcccgtgcattgcaggacatccagcagcatccccggcctcctgctccgtgccagtagcgccgcaccccgccgtcgtgacagcccaggtctcccggtgtgcagaatgcccgctggtcatgctgagaggtacaggggtgctgcccccagggtttgaacgctgtctaactcccacctctggtgtgtctctcccctgtgtgtagcgtggagtcactggatgagtgtggtgacctccctgtgtccagctgccctgggctgcaagcaggtccctcctgcagccctccaggccacccttaagcagagctggaccagcctggccaacatggtgaaaccccatctctactaaaaatacaaaaattagccaagcgtggtggaactctgtctcaaaaaaaaaaaaaaaaaaaaaaaagggcggcc

SEQ ID NO: 739 - DNA, 540 bp, Homo sapiens
ccacgcgtccgacctcctacatttatgagcaaagctcggtttccctttttggctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaaatgggggaaattgaatatggactgggaactaaatgattgaaagtagttttgttaatcttgttggtataatattttgtagttctgtttttaaactgctgcagtgtttatggccagagtctaaatgtttacgagttgctttgcttttaaaatattccaacaaaaaaaaaaaaaaa

SEQ ID NO: 740 - DNA, 2067 bp, Homo sapiens
aattcggcacgaggaaaaacaaaagttttttaaaacaataaaagttaacagtcaataatgtgtttgtcggcaagaagccctctgttaataatggtctaaacaaataagacattgtttttctccaataaagaaatccagaggcaggcagtagctggctttgattcagcctctgactgtcactgtcagggccccaggccccatgagcctttcgtctttcctgcatgttggcttatcttctcatgcttgtgacttcctggttgcaacacggctgctgcaacaccagacatcttgcctgtcttcaaggcaggaaggagggggaaactatcgcctaccagctatttttcttaccttagctcctccatgtcttggatcaaaagcatctctttgaacctctccctcaggcataccctgaaatgctgtggactttaaccttttttctgttgcaaaggtcgctcacatctccctggttgtttggtcttctcttccttggctctagtaacacagcagtctgttgcttcctaggacaacttataatgggacccaaaggggaaagaggatttcccgggcctccaggaagatgtctttgtggacccactatgaatgtgaataacccttcctacggggaatctgtgtatgggcccagttccccgcgagttcctgtggtaaggctttctgggagaagtctggggtggttatccgtgaggacctctcacctgatccttatggggctttgtaaaatcctttcagtaaaactaactttttttcacgactctgagtacaccctcattataggaaattggaaaatatgagaaaatcaagaggaaaaccaaattgtccatttgattgtgagtccattttggggtattttctttgtcttattaaaatctaacttttatatggttgagattatattgtataaaaatgtacttttggccgggcatggtggcttatgcctgtaatcccagcactttgggaggccaaggtgggtggattataaggtcaggagttcgagatcagcctggccgatacagtgaaaccccatctctactaaaaaatatatttaaaaaattagccgggcgcggtggtgcacgcctgttgtctcagctacttgggaggctgaggtgggagaatcgcttgaacccaggaggcggagattgcagtgagctgagatagcaccactgcactccagcctgggcaacagagcgagactccgtctcaaaaaaagttatactttgktatcttagttgaaatcctgccatgtttccacactctataaataacattttaaactttttattagggaaaatttcaaatacatataaaagcagaacaaatagtgtaatgaacccctgtgtacccttcacccaactttaataatgatcaactcatggcgagcctgtgtccttgttttctctttatgcctactcactcctgcccattctctgttgtattattttgaagtaaaccttggacatctgttcatcataatcatccatctagtgtggctgtgctacaatttacttaaccagtgttggtgtttaaccaacctattgcttattggccacccccaagctttttactaatgtaaataatgctgtaaagaatatctttgagtaggataattttaagaatcacttccagatgtcaaattacttgactatatgacattgccttttaacttaagtcttgggaacgttttaaatatttaaaaatgttaaatccgaggccgggcgcggtggctcatgcctgtaatcccagaactttgggaggccgaggtgggtggatcaccttgaggtcaggagctcgcaaccagcctggccaacatggcgaaaccctatctctactaaaaatacaaaagttagccaggcattgtggtgcacacctgtaatcccacctactcgagaggctgaggcaggagaattgcttgaacccgggaggcagaggttgcaatgagccgagatcacgctacttcactccagcctgggcaaccgcgtgagactccatctcaaaaacaaaagaaaaaaaaaaawaaaaaaaccggcacgagggggggcccgtacccaatcg

SEQ ID NO: 741 - DNA, 1175 bp, Homo sapiens
ggcacgagattgaatgttccagataatccctttcccagtcctgcctgacatctgggtagggggtttgtccctggaattctgggacactggctggggtttgaggagagaagccagtacctacctggctgcaggatgaagctggccagtggcttcttggttttgtggctcagccttgggggtggcctggctcagagcgacacgagccctgacacggaggagtcctattcagactggggccttcggcacctccggggaagctttgaatccgtcaatagctacttcgattcttttctggagctgctgggagggaagaatggagtctgtcagtacaggtgccgatatggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcctgtgattccctggttgacactgtgttcaacaccgtgtggaccttgggctgccgcccctttatgaatagtcagcgggcagcttgcatctgtgcagaggaggagaaggaagagttatgaggaagaagtgattccttcctggttttgagtgacaccacagctgtcagccttcaagatgtcaagtcttcgagtcagcgtgactcattcgttcttccaacagtttggacaccacaaagcaggagaaagggaacatttttctacagctggaaagtgagtcctatcctttgaggaaatttgaaaaaagacatggagtggtttgaaagctactcttcatttaagactgctctccccaaccaagacacatttgcctggaaattcagttcttagcttaaagactaaaatgcaagcaaaccctgcaattcctggacctgatagttatattcatgagtgaaattgtggggagtccagccatttgggaggcaatgactttctgctggcccatgtttcagttgccagtaagcttctcacatttaataaagtgtactttttagaacatttggaaaaaaaaaaaaaaaaaa

SEQ ID NO: 742 - DNA, 712 bp, Homo sapiens
  misc_feature (1)..(1): n equals a,t,g, or c
  misc_feature (338)..(338): n equals a,t,g, or c
nctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcagnctggaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacaagcgcccagttatgtggacgagctgttaaaccagccgttcttggaacacctcacagcttgccacatctgatgaatccatccatctctcctgcatttttacatttgaataaagcacatcagaatctttctcatataccactgggcacaacaaca

SEQ ID NO: 743 - DNA, 1715 bp, Homo sapiens
ggcacgagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttccccagagctgtcgccatttccaaagcccagacttgggaactcagtacctggttgcgctgaatcagaagttcactgactgctctgcgctagtgttctggactccacttaggaaagacgtctctgaagtggttttccgagaagcccttccagtacagccccaggacacgagaagcccccctgcccaactggtctccacctaccaccacctggagtctgtcatcaacacagcctgtttcacccttctggacccgcctcctctgaagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagtcagcagagaaactgaagtgttagacactatgtgtcccaccaccccattacagagacatatgacaatgaaaaaaaaaaaaaaaaaa

SEQ ID NO: 744 - DNA, 656 bp, Homo sapiens
  misc_feature (148)..(148): n equals a,t,g, or c
tcgacccacgcgtccgcttcccaatatttctcatttttaaaaatattttttcttacactagaatgttattccttgtcttttctttggktcttttaaaacccttgkttttcttcycttttgggggagmccgaattgtaaatattgrgantwttcagtmccagcaccatgctgaaggaaagwtrggtagctaataccttttttttttttgagacggagtcttgcactccagcctgggcamcaagagcaaaactccatctcaaagatataagtgttttcaactggcgggtaagaaaaactgctgctgttggttctctaacttcttacaacggtggttcccacttaatcttatttaggtcctggagccctaaaaaaaaaatctgaaaaacctgcagtctgtcttcccagaaacacttgtgtgaaacgttctggtgtttttgtgttgagactgggtgacagagcaagactcagtctcaagaaaaaaaaaaaaaagaatatacaccagcctgggcgtggtggctcacgcctgtaatctcagcacttttgggaggccgaaggcaggtggatccacctgaggtcaggattttgagaccagcctgaccaacatggtgaaaccccatccctactaaaaaaaaaaaaaaaaaaaaaaaagggcggcc

SEQ ID NO: 745 - DNA, 488 bp, Homo sapiens
ggcacgaggagagtagaggctattcatgtaatgtctataaaaaaataacaccaaggctgggattacaggcatgagccactgcacctggccagtttgcttattttgtttggtgcctcctcccatgggagacctcaaggaggtatgcctgccccacagatgccctggaaggacagcttgctgctcctactcagaaccacacctgcagacagaggaggacagacggacactcatttgctgagcacccatgtaacatgaactaagagctgggtggagacaatgaacggtggagccatcgttcccgatgtggagggagaacagctcaagaccacggaacagcctgctctcccgcttcctggcttccgtgcgcttttgtccaatcaggctttttgaccaatcggccaggcgcgctatgtaaatttctgacattttcaaagctgtctttttaataaacctttcagtgtaaaaataaaaaaaaaaaaaaaaaaaaa

SEQ ID NO: 746 - DNA, 1555 bp, Homo sapiens
  misc_feature (1248)..(1248): n equals a,t,g, or c
  misc_feature (1389)..(1389): n equals a,t,g, or c
  misc_feature (1391)..(1391): n equals a,t,g, or c
  misc_feature (1393)..(1393): n equals a,t,g, or c
  misc_feature (1396)..(1396): n equals a,t,g, or c
  misc_feature (1551)..(1551): n equals a,t,g, or c
ggcacgagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggattactgggagcagctaagatgcctaratgaaaggtttaccatcactgctggttaggaaatggattatgagaactcgaacagagggaaggtgaaatgcaaccggaggaaacactctgatatgaggtttgaggccttcaaaattgctttgcagcataagccacagtgagtcaggagtaccagggagtggatagaatgtttatttgtttaactgagactttttagttcatcaattattttgaagggtagaacactctgtgggctctctttctatttccttctgggtacaatcacaaaaaaaaaatctctcctagctgaaattacatgcagtactagcaaagggtctctttgttataaactgttcattaattgacgaacatttgtgtacttaactatgtataaggcatctcatcgttcaatttcaaatacaaattaaaatattttttcacatttgttatcctgttatgttttctcttttacaaattgtctgttcgtatctttttgtctctctttaggccttattcttgtcaattcatatgtgctctaatgaattgaaatattttctgtatattaaacattactaacctttcctctgtcacactgattgaaaaatgatctatttagtttgttgttttgtctttaattttgtaagctttaaaaagttaatattgcccttcagacaccatcccaacatcacataagaattttttcatgttataaattctttgtggacatatttgataactgttttattatgaggaggaccataattaattcaaccattcccctattttggtcatttaggtttttgggtttgggttttttgtttgtttaacgtctttgcttgctattttaaagaatgctgcactaaatgtgaatgcttgagatttcttctctgtatttagaatattttcctagaatggattctcagaagaattctcagtctgtggagaggaacatttttaatgcatggaagagctggagtgaaccgaatttcanactgccctgctgatccagaaataagtttgcttacggaggcttctagttctgaagatgcaaagttagatgccaaagcagtggaaagattgaagtcaaacagtcgggcccatgtgtgtgtcttacttcaacctttggtgtgtnananggngcagtttgtagaggagacctcttacaaatgtgactttattcaaaaaattacaaaaacattgccggatgctaacactgacttttattatgaatgtaaacaagaaagaataaaagaatatgaaatgttaaaaaaaaaaaaaaaaaaaaaaaaaaaanaaaa

SEQ ID NO: 747 - DNA, 676 bp, Homo sapiens
  misc_feature (1)..(1): n equals a,t,g, or c
ncctgggggagagtggatccaggtgaagggggcagaggttacctgtgcagggatcagtccatttattcctattttctctgacagctggatgaaagggactgggagttttcgtcctcttgaataagaactcgacaacagagtgggaactttctgtcttgtgatccattgcctggctttctgtatttgtctgaatgctttcacgggagtgtgtcgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatg

SEQ ID NO: 748 - DNA, 1061 bp, Homo sapiens
  misc_feature (138)..(138): n equals a,t,g, or c
  misc_feature (460)..(460): n equals a,t,g, or c
  misc_feature (473)..(473): n equals a,t,g, or c
  misc_feature (1048)..(1048): n equals a,t,g, or c
acaccaatggagacataattgtgggcagactatgacaaccgttgggtcagcatcttctcccctgaggggcaagttcaagaccaagattggagctgggccgcctcatgggccccaagggagtggccgtagaccggaatngacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccnaggtattcgacanctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaaaaaaaaaaaaaaaaanactcgcggcacga

SEQ ID NO: 749 - DNA, 1064 bp, Homo sapiens
gcggaggggtttctgtgcaggacgggagtctcagagaggagacggatgtgggggagggaggccggccacgcggtggacagagcgagggtgccagggtgacccgaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggatgggacttacctgcacgccccaggggtctttcaggattcaggatgacttttcttttacaatggtttcctctcggcagagcccgggttgtgggggatctgtgtgggttctcaacgcagatccatcctggggtctcccgggcagggatggctgacctcgagtcccctcccttcccgagaacctgctctgtcccgagggcagctaacaagggctgagccccaggtacaggttgcctcctccacggcaggaatttttaccaaaaccacaagcaaaaaacaaaacagaccaccacgaccaacaacaaagatggggggtarggttttgtaaaggttctgttaggttcatatttttatatcattttgcccataaatgcggaatttgccgtgggaatttgaagacaaatgatctatgtttttatggttttctagggaargtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcattgatggttaaaaaaaaaaaaaaaaaaaaaaaaaaaaaaaaaaaaaaaaaaaaaaaaaaaaaagggcggccgc

SEQ ID NO: 750 - DNA, 1523 bp, Homo sapiens
cagacattgttagctactgagtggcacatcttcagtacgcatggattcgtgggggactcaggcagaggtaaaagtgtgaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaramaaaaaaaaaaaaaaaaaaaaaaaaaaaaaagggcggccgc

SEQ ID NO: 751 - DNA, 1215 bp, Homo sapiens
ggcacgagcttttcagtactctcacttattcatgacacaggaatgaccctttactcaaaactcttgtggttgttcaaaggtgagcttctttttcccttagtcttagcctatgtgttgctgttgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagttttaagcctgggcaacataaggagattgtttctatgaaaaataaaaattagccaggatggtggtgtacacctgtagtcccagctactcgggaagatgagattggaggatcacttgggcctgggaggttgaggctacagtgaactgtgattgtgccactgtactccagtctgggcgacagtgaaatcttgtctaaacaaaaacaatttaactgggaagcacagtggtccttgaggacatttaatatcaggacaaagagcctatgaatatatcactgatgtatataaaccctaaggcgttaataaaagctaactgtttagtgttatccatttaagggaacaggaggaattgcataacttttagattagtcatagtggtgcctaagggatatgctgtggtatatttgtatagccagggcacttagccttccaaccaatttatataccatgttcttcaactgtgggtgagatttagcctcaagatttgatttactatatgtaagtacattacttgatttctataaagaatctttagtggaagatgttattctgaattatttatcaatatgattaatccagttagaaattattaatgatcttcctttatactatacataggataacttttaacttgtcgctacagttgttgctctgaggatcttaattttgttactttctaggctacatgaagctatctttttaaaaagtgtactcttcattttcactgttattgtgtacttagcataaaaaactcaaatctaggccaggtgcagtggctcatgcctgtaatcccagcactttgggaggctgaagcatgcggatcacttgagcccaggagttcaagaccagcctgggcaacatggctaatgaacactaagcatagttttgatgtctttcatattaaagactttctcaaattcttaaaaaaaaaaaaaaaaaaaaaaaaaaaa

SEQ ID NO: 752 - DNA, 1543 bp, Homo sapiens
ggcacgagatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctgtgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagactagggagctattccattagtagcaaaatgttgtaattcactgaaattgctgttaaccaaaaataagtaatacaacatggcattttgtgtgggttgacaaatgaaacaggccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttaaaaaaaaaaaaaaaaaaa

SEQ ID NO: 753 - DNA, 954 bp, Homo sapiens
gaattcggcacgagcccacaccaaacctgtggacgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagccaaaaaaaaaaaaaaaaaaaaaaaaaaaaaaaaaaaaaaaaaaaactcga

SEQ ID NO: 754 - DNA, 1747 bp, Homo sapiens
actaggcttttgcaaaaagctatttaggtgacactatagaaggtacgcctgcaggtaccggtccggaattcccgggtcgacccacgcgtccggttgtccaaaaagctttctgaggtatagttacttttagaagaggaaataccgttttaattcatttgtgctcttgagattgtgtatgtgtggtaggtgtttttgttgtattattacaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaaaaaaaaaaaaaaaaaaaaaaccggcacgagggggggcccgtacccaa

SEQ ID NO: 755 - DNA, 1015 bp, Homo sapiens
ggcacgagcaaaaggggcttctattgtattggtcatattttattttggtttaaaaaattttagagtaaatgtggcaaaatgttaatgcttgttaaatctgagtggagagtacattggtgttaagtgtgctgctatgcagggtgagtgaattactcaataactaaataattgtgacataatatatttatttatgcttccctgttatgatctacacataaaattactggagcattattgcttaacttcttgtaaaaaagttctgcaattgtagtgttattaagaaagtaatattgatttgtatagtgacagaggattttttcagtgtcactttgccagcagagatcttcatggtgggcattgcccctgcccatgtctcacttggccctgggcttgccccactaggtaccctgcccacctggccaggcaggctgtgcttggcttgagctctggcccagatcctgcacttgctctgcggctgagccaggcatgccatgacctacttccaccttgggagccggcgtctggatgaggggaatgctgtgacacttgaacagaggtgggcatgtgaccccaaagccccaaagggggtgttacagcatgctaacagttctttcagtctcacatccacagcccaacaaatggaggtgtgtggtgcccagaggtcccttctcccattgtttggcaagcaggaggggtgtgctacagggttacagctttgtttgcacttgccgtttggtgggtcctgagttcttttcccatgtccaagaataaggttgtgctgacagctagcggttgagtgaggcaaagagttttactcagtaacaaaacagctctcagcagagaaggaagcctgagttggacagcacccttacctgaagttgggtagtcttcccaccacctaaaagtgggtagcccaaagtgtggctgagcctggggcttttatatgctcagaatgggagtgtatgtgctaattggtttgtgagtatgcaaaaaaagctaaaaaaaaaaaaaaaaa

SEQ ID NO: 756 - DNA, 913 bp, Homo sapiens
ggcacgagtgaatatttttaaggctcttgatttgctggaggactgaaaaaaatgaagtgatagtgtctgagaatattcatttgacttattttttacagcatccattccctttcatgttgggagtgttctctttagtggcttaaattctttgcctgcctttgggagtgtggagggtggagtggaccttttgagggtcgagggtgaatgtggccttgctgtttggatagccttttgtttggattctggctctgggcacagggaataacactactttctgaggacagtatcaggattgtctgtagttcctgtgagcctgaggtgctgcatgtgcccacccccgtgtacaggccctgccccagccacagcccactcaccttttgaccctcctgctctgcctatacagtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaaaa

SEQ ID NO: 757 - DNA, 1237 bp, Homo sapiens
  misc_feature (942)..(942): n equals a,t,g, or c
  misc_feature (949)..(1184): n equals a,t,g, or c
  misc_feature (1187)..(1187): n equals a,t,g, or c
  misc_feature (1194)..(1194): n equals a,t,g, or c
  misc_feature (1196)..(1196): n equals a,t,g, or c
  misc_feature (1218)..(1218): n equals a,t,g, or c
gcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctgggctttattggaccataaagtctattatagcttggaaggttaaaaaaaaaaaanaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnaatgggncncgcccctggtttccgggccccntttaatccccgggcggggt

SEQ ID NO: 758 - DNA, 1079 bp, Homo sapiens
tcgacccacgcgtccgggtttcaccacgttggccaggctggtctcaaactcctgacttcagttggcctcccaaagtgctgggattaaaggcatgagccactgcgcccggcctacctttctaactctacttctagcttcttgcttctgggctgctgctataccaaacaggaatgtaatactttctgtcagcttcaggcctttgcacatgcagttcactttgtctatcttggtttttattcttaggattttaattctcctaagaagctttctctgaccagcctaaaacttacgtaagccctgggttaggtgctatgcttatgtcctcccatagcattttgcatttgcatgtgttgtaactcttaatgtacagcatcatgattgcctattttaactttcctgtttgttacagtagactttaatctctttaaggacaggaactgtgtcttgtttagaatccccagagcttatttagtacaatggctatgcttataatttaagtatttattgaacaaatgaaattttcctaagccctaaaaccttgcaagatgttttagtgcaggaaactggcctcggtggagttgaataactagcacgaggtcactcacctaaaaagtggtgaggagggattaaaatctaaatctgtttagctgtaaagattgggcttttttycttgctgctgcacatgactgcyctctctcatgttgcctgtacacatccctgtcaagtgttcaaacagcccgtgcctaacaaccccatccatagcttctgaggaaagttgtgtcatctttggacagctctgagagctgaagcgagtctttgcagaataatttcccatctattggtcttaatttatgctttggagaatataacttattttcaaaaaacaaatgattcagaatttgtcatctccttaaggtccgtttattagtttatttcattccttcattcactgataaccatttactgagcaccagcctgggcaacatggtgagaacccatctctaccaatttaaaaaaaaaaaaaaagggcggccgctctagaggatccaagcttacgtacgcgtgcatgcgacgtcata

SEQ ID NO: 759 - DNA, 1420 bp, Homo sapiens
ggcacgagcacaagctcaagaggccgcttgcacgcatgtggacactccatgattctgcttctatctctctttcagggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggttgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagcttaaaaaaaaaaaaaaaaa

SEQ ID NO: 760 - DNA, 1871 bp, Homo sapiens
ggcacgagggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgaaaaaaaaaaaaaaaaaa

SEQ ID NO: 761 - DNA, 1173 bp, Homo sapiens
tcgacccacgcgtccgaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggatgcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagacccggtctccaaaaaaaaaaaaaaa

SEQ ID NO: 762 - DNA, 556 bp, Homo sapiens
  misc_feature (513)..(513): n equals a,t,g, or c
gaattcggcacgagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatggtatgagggagaggctaaaattgctcttttgggggactgttgttcttatttcaactatagaaggatatctgtggtcaatgtcaggtatagagatgattgcaggcaagtgctggagaagtgaatagtatccaaggtggtcttgaatatgtttgcttttgtcatattggttttcataacatccatgtgggcccagaccataagcttacatgtctccagtagtgaggaagtttcctgttaagaactctacccaaggagccatattctcgaaggggggggccggtacccaattcgncctatagtggagtcgtattacaattcactgggccgtccgttta

SEQ ID NO: 763 - DNA, 748 bp, Homo sapiens
gaattcggcacgaggagcccttggccagctctgagacgctttgtgagaccccaaggtgggtgttctagaaggaagaagctttggcttgcttactggaaccaagacaaaaattccaaataaaattccaaataaaaatgtaaatcgagttttttcctcgattgtcacagagactctggtgaatatgttaagttttcagaaagcgattcttttcctagcaatgggctgcttgccttgcattcctcaaggcctgtcctgtgccttccatcctgcatccttccacaaggctctgagtggctgtaggaccctcatatgacaggaggaggaggctgaccttggccaaggtcacatatcccttcttttatccattcgaaaggctcttgctgttgactgactatgcagcagacatagctgggccctggggagatgtgcaaggcaaacacacccaagagattcctgccttcactgagcatgcaccgcagagacacgctcagtcacttctccctgagctctcgcagcacctcagacatgcctctagtttaagcctctacttttaaatgtaatccctgtgcatggcacaccataggtactcaaacaggggctggtggaactcttgagggagagggagtgccactgattcctcttcctgagatggaagtgtgcgtgcatccgtaccaatgtgcatgcatgtgtgtgtttgggggaagacatagtaaataagctgagtgtttcttgttctccatggtctcga

SEQ ID NO: 764 - DNA, 491 bp, Homo sapiens
ggcacgaggcaaaagcttgtgctgttagctttaaagtgtatttaaaataaatctgaaatcatttaaacagcatgaaccttggtggccaaatagatcaatgacaaagaggagaaaacctagatacaggttcatttttgccttatatgctttgagattagtgtttctatttagagctgtgactaatacagatgcatcacggctgagagcaaagcgaggtgaatgtccctattaattgccaccatggtgcgaggctggaatgagggtgtggccagctaagaggggatttgctcttcttgccctagaagttcctcattgtttcctgtcctgtcttgtgtccagctgcttagcacacttccttttggtatttaatgctttttatagctggaaccctgaggttcctcagaaatctgcacatgcttactagatggtgctctggattttctttaaagataggaagaaaaaggcaaaggcaggtctgtgacgcttcttac

SEQ ID NO: 765 - DNA, 527 bp, Homo sapiens
  misc_feature (492)..(492): n equals a,t,g, or c
  misc_feature (494)..(494): n equals a,t,g, or c
  misc_feature (522)..(522): n equals a,t,g, or c
  misc_feature (526)..(526): n equals a,t,g, or c
ggcacgagaaaaattctcaagacccatgtgaaagtcagagaggggtgtggtggcctggctggcctgaagacaggtgttctgatgattctggcaggggcccccatttgcctggcactgaaattatattagtatctttactgtatgagcaccgtgcccatcagggcaagctgtgactcctgtcaccaaacactcaggaaccattgcttttggggcctccaggatggtttcatttgtaggcatctgccttctgttggggtcctttttttctccttctctacaggggacaatatggcaccacccagcaaaacctgatgggagtggacatggactaccctcatttgcagtaatcatgggcaagcaggtggtacccacagtgtactggagaatgccctaccctcgwagggggggtcccggtaccyaattcgccctatagtgatcgtattacaattcactggccgtcgtttacaaacgtcgtgactgggaaaacctggngntacccaacttaatcgccttgcagaaatncccnt

SEQ ID NO: 766 - DNA, 985 bp, Homo sapiens
gtcggcacgagtaataaaatctaacacctgcttagagaccattcttgtagtggacacaaagtgccagcctctaatactccttccttactcttcatggaaaccttgaagagtgattaaaaatagtactgtttatgtctctgaccacagagccagtcattttcagcacttaactgaaattgctcatgatagtgtttctaacaatggccacataagtggcaaatcccttaagaattttgccctctcagcaggtggcaatctgccacctttatctgatcatttctctcctcctttggcattgtagacaccattttttcctggttatgaccctacttctctttatcttctttgtcgattgcttttccactccagggagttctgtgtttgacacacaggaggtgtgggtagttgtttactctgtaaataagttgttagccgtgcagcactgccaaggaattgcaccaaatgtgtatgcattagcagttaagaagagcgtgtgcaatgttagtgaatggagtctggtcatttgtcatccaatgcctatttagcacctgttatgtgacagataacaggccggcactcggatcataacccggagcaacatagtcagaaacaaacacaatttctctccttggtaagcctggtctgttgggaggtttgataagtaaaaagaagactgagargccgggagcggtgctcasgcctgtaatcccagtactttgggaggccgargtgggtggawcacctgaggtcaggarttcaagaccagcctggccaacatgataaaaccccgtctctactaaaaatmcaaaacctagccargcatggtggcaggcgcctataatcccagctactcgggggctgaggcagaagaatcgcttgaacccgggaggcagaggttgcagtaagccgagatagcaccatcgcactccagcctaggggacaagagcaagacttcatctcaaaaaaaaaaaaaaaaaaactcgag

SEQ ID NO: 767 - DNA, 699 bp, Homo sapiens
gattcggcacgagaaacttttaaatctttagttatttcttaatacttagaacacttaaacaaaactttacaaaacaaaagagcagaataattagatcctttcaggagaatatgacttttttttcctaagcacactggaccatagaggaagaccaaaggaatgtacagttgcctgctccttcctgacttgctgtatttgactctgtccccactggtggtggcaatgctattaaccccacactttaacgtggcaaatccccagaatctgttggctggtctctggctagagaatgagcacagtttcacccttatggctccagaaagagcaagaacacaccactgccagccagaagagagaaaagtcttgttctgtctctttcccattgtcccaaatagccaagcacaggttcaaccaccccaaatgccacccttctgctgtgcagcagccaaggaaaagacccaggaggagcagctccaagaacctctgggcagtcagtgcccagatacttgccccaattctttgtgtccaagccacactcagctgacaaaagccaacactttgtctctctttttttttttttctttttttttgagcagagtttcactcttgtcacccaggctggagtgcaatggcaggatcttggctcattgcaacctccacctcccgggttcaagcaattctcctgtctcagcctctcga

SEQ ID NO: 768 - DNA, 2794 bp, Homo sapiens
  misc_feature (164)..(164): n equals a,t,g, or c
aaaaagaaatcttgcatttgacacatgaaaaagtaactaaaagcttgcacggagatatattaagcccttgcactaaaaatgctggtactgtttaaattcctcccgttgacttcaagtgggcgcttttcatccgtaacattgtatcaccgggtgcaccaccagancgttttttcgcaggaagcgaagtcattctctccggcgtctacacttaacttgtatatttgttctagccaatttcagtcacttcagaaactttactgtggcgtaattccagttcttaggtacgcgagcatagagtgaaaaaatagctgtgattgttcttatgtaaaaatcaaagctccaatggaagttaatgaatacctttgtaataatggaatctatttgccctttatttcttaatcttctgttttaaactgctgctattaaaaacacacccatgttattaggtttacggaagttgagctgtcgttcaagttcttggcgtccggaaaggtgtccgtgccatgggcttgtgacccggtcctggatacaccagaaacatcaccttcttgccacctaaaagagaatcgcactcacaaacgctgtcacaaccgtctttatgacatcaatctcccttgttccggttctctttttacaaaaaagaatttacttcattaaacaatttccgtctctagtttaaacagaaggtggaaaaaaatagaccccggtctagactcattttctccagtccacattggaatgggtttaagaatatcctcttccaaacaaaacaagacgatttgtactttgtgtctaagatgtctaagatgaaacgtttaaaactctgattaccacaattttggattttttgttaaaatcaaatgtattttcaaacttactgtgttacaatattatagttaaaaagtacagggagagcagaagccctgatctaagaggtgagtcattgtcctcatgttgctgctaacttgaattgcagaagagaaaatctcagtgccttctgcctggctttttgatggagtttgcttaacacccttcatctttctgtttctctccatgtaactaaatgacgttttaaaaattcagtgctgaggtgtctgggtagcacagcggttgagcctccgatttttggtttcaactcaggtcacgatctcagggtcatgggatcgagccccacaacaggctccacgctcagccgggagtgtgcttaagtttctcgctctgcccctgcccttccccttcccctgctgcgtgcacctatgcactctctctctcaaataaacaaataaatctttaaaaataaataaataaaacacagtgcataccataaaacattaagtaatatgcgttagggaagcatttgagatcatgcatagcttatatatttcaaaaaggatttgttcacatcagtacaatagatagatataaaagaagcaattcttggagcgtctgggtaaagaaggtagtgctccggctcagcaggctttcccgtcaagccactgatctccacccggctctcccgtgttcctcttcaataactgagtgcagtctatgagcagatgctgccttctgccacataaagtatccttaacttttactttgctttgagtttaaaccagcattgaaatgtaaatcacgtcttcctcatgcatgaaattgtgagggaagtcagagaggttctctaagagtttatttagcaatgaggaaacaggacaaagaggaggtagtcccatagtggggagggtgggaggcggggtctgccgggcagcactgggtccagcgtctccctttccctagctttctcccaattttctttaggaaaaatgatgtcatagtgagatttcctataacagaatgtttctaaggttcactgtatggacccagaccccagacggttgtcttataagcgaacttagaacggatgctgggaactaagtacttgagtgttgacttgctcacctgcgtgggacagagggacaagccagcaagcccccatgaagtgacgggcagccccacctgggccctggagagaccgacgcaccctctcagctggggtgcagagaaaggattggtttgggggatagcagtggactgtcagaagaacttacgggatcctattgtaatgtaagctatgaatcaggcttgctgtcctgggactgaggttgtaacccgtgaacgacgcaccaacacaggcagctgatgcgtttgctttggcttccaatttgctaatataaaaatctagacttgtttcatgaaaacaggacatttaaacattctatgaatattctccaaaaatatttggggaaacctatgtacacatttctgttggactgacacctagaaatcaaattgttgtgacagaggatgtgcctatgttcagcttcagtaaatactgccggagagatctctgaatgataaacagttaacggaaaatcgcaccaaaccaggctgttggaggcaacaacccattgggctagtttctggtggcctgctgcagccacgcaggcgagcactgggcttcagactgcacgggactctctttgtccacctgtcctgtgcctggccccacaccaggatgctggcgattatcaaatacactttactggtgattacctttgagcatatttgctttcacaaatcagttctgtaactttgtgtgcattgggctaaattttacaaactaatcattggttaaaaggaagtggcctaaggtccccagtcttgctgatatcagggcagctgctcctttggggttcctcgtcttccatgggtgaagcatgggagtgaggggccccat

SEQ ID NO: 769 - DNA, 1491 bp, Homo sapiens
ccacgcgtccgggagccatggcgccgtccgggccgctgctgctggtgctgctcgtgccgctggccgccgcgcgggccgggccctacttccgtcccggccggggctgccgcctgcccctgcggggggaccagctgtcggggctggggcgcaggacctacccccggccgcacgagtacctgtccccatctgacctgcccaagagctgggactggcgcaacgtgaacggggtcaactatgccagtgccaccaggaaccagcatatcccccagtactgtggctcctgctgggcccacggcagcaccagtgccatggcgggaccggatcaacatcaagagaaagggggcgtggccctccaccctgctgtccgtgcagcacgtcctcgactgcgccaacgcgggctcctgtgaggggggcaacgacctgccggtgtggaggtacgcccatgagcacggcatcccggacgagacctgcaacaactaccaggctaaggaccaggaatgcaacaagttcaaccagtgtggaacatgcacggaattcaaggagtgccactacatccagaactacacgctctggaaagtgggtgactacggctccctctccggcagggagaagatgatggcggaaatctatgccaacggccccatcagctgcggtatcatggccacggagaagatggtgaactacacgggaggcatctacgcggagtaccaggatcaggcctacataaaccacgtcatttctgtggtcggctggggcgtcagcgacggcacggagtactgggttgtccggaattcgtggggggaaccgtggggggagcacggctggatgaggattgtgaccagcacctataaagacgggcagggcgccagttacaacctcgctgtcgaggacacctgtacgtttggggaccccatcgtttaagggacaggtctccccagaagagcagtgttatcgtgaaccataatcagggggtcctatcgctctgggcactgggttggttccaccatggtctgaagggactggggactggcatcaaacgtgtctgatggctgctcgcggccccgtgcgcccagaagggagaaggggcgcctgtcagcacacagcctgccgcggcgccggccgggagcgcgctcctggggaagagtctgcaatgggacggctgagagccccgggccggccactgccctgccccagtgtctgcctggccaccgtgtgatccgcaaggcccaaacgatgtgactgccaagctcctctgtccctgatttggtgtttcctgtctggcagctgtggtccatgatgtggtgcggaagcccaggcttctcaaagctcttacgttgcctgggattcggtgggggggagtcggggggtggagggagaagacggccctgtgagattgcccaagtgatgaataaagtacgtgaccccgcaaaaaaaaaaaaaaaaaaaaaaaaaaaaaaaaaaaaaaaaaaaaaaaaaaaaaaaaaaaaaaaa

SEQ ID NO: 770 - DNA, 1531 bp, Homo sapiens
tcaaaagactacttagtgacactataaaagttacgcctgcaggtaccggtccggaattcgcggccgcgtcgacgaagtgctgaccaattgccactggacatacttgaaacaaaataggaaaatggcagcaaactcttcaggacaagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctggtcttgaactcttggcctcaagcagtcctctcgatcctcccaccttggcctcctaaagtgctgagattacaggtgtgagccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttcaaaaaaaaaaaaaaaaaaaaaaaaaaaaaaaaaaaaaa

SEQ ID NO: 771 - DNA, 741 bp, Homo sapiens
  misc_feature (35)..(35): n equals a,t,g, or c
  misc_feature (39)..(39): n equals a,t,g, or c
aattcggcacgagacccttaggaacacggacgcancgtncggcattgtcatctacgcaggacatgaaaccaaggctctgctgaacaacagtgggccccgctacaagcgcasaagctggagaggcagatgaactgcgacgtgctctggtgtgtcctgctccttgtttgcakgtctctgttttcagcagtcggacatggactgtggatatggcggtatcaagagaagaagtcattattttatgtccccaagtctgatggaagctccttatccccagtcacagctgcagttaactcatttttaacatgatatagttckgcaggttttgatcccatttccttatacgkttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgagggtctattaagagatgcgcagtggtccacgcggctggccggctccataagtatctccttctccggcctcttgacaggcccctgctgctttgactcagcaccatgcctgtgcttgaagttctgattaaacggttgttctgataagtaaaaaaaaaaaaaaaaactcgta

SEQ ID NO: 772 - DNA, 323 bp, Homo sapiens
agcacacacctcctttagttgctcctaaggtcatgttcaacattcgtggagtgcattttctgctcagggagctttcccagacccggaatgtttggtgctcacagacyctggcaaggatcggtattgctgttcctcagttttgcctggggaaatggaggstcagtgacgttcagtgacgtgcccagagtcatgccattggcgggtggcccagkgmtccaggtctccagcacccctcggccccctcctcaccaggtcacatcatctcctggattagaatctgctcacatagtctgtcctgaaaggaaaaaaaaaaaaaaaaaaac

SEQ ID NO: 773 - DNA, 585 bp, Homo sapiens
  misc_feature (5)..(5): n equals a,t,g, or c
  misc_feature (15)..(15): n equals a,t,g, or c
  misc_feature (19)..(19): n equals a,t,g, or c
  misc_feature (29)..(29): n equals a,t,g, or c
gttgnatcccccccngggncttgccaggnaatttccggccaccgagggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaagtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaaaaaaaaaaaaactcga

SEQ ID NO: 774 - DNA, 773 bp, Homo sapiens
  misc_feature (459)..(459): n equals a,t,g, or c
  misc_feature (503)..(503): n equals a,t,g, or c
cggcacgagcttttgcccataggataagtacaaactagatctggttactgcctgccccaccagcctcagtatctctcacaactaggactaactttttcttctgacaactataaaatatttcccttgccttctcaagtttgctcaaggtcaagttatgccttttgcctggaatgacttgacttctcttttgttttacttagctggctgcttttcatcttgtaggttaggtcaagggactccaggaagtcttccctggacaagtaatgaagagggcataatccaagggccaactcccatgttttggaacctgactccattttcaggcacgtaatattgtcaaattccttttaaaagcacctgtctgtctgttaacgttggtgcagatactgctattcccctcctccataccattgctgatggttactgagggtatgggaagggccgactagtccagctgtncacaaacagcccttaatgtcaaactgaatactgccaacgtagtnccagtttctgtatctaaagactcagcttggagtcacttgtctggactaaaaaagtacccctccttgtctggtttgtgactttctgtactctgatgcccccagctttctgccttctagaaatttgtcagaatttccaaaattcttgggccttccttcttgctctatatatggttttggattcattccttttaaaaaatatttactgtcatttcagtagaattttgacacaataaatataagcacatcaaaaaaaaaaaaaaaaaactcgga

SEQ ID NO: 775 - DNA, 795 bp, Homo sapiens
  misc_feature (1)..(1): n equals a,t,g, or c
ngaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccaggtgcagtacaatgacatttttaaaaatcgcccagcaaaggtctttgaattttatttcatccaagaaaatccacagctctttaagctctagatttgtccaaatttaaaatcctgaagttagagatggtatttcactccttcctctattcccaggacctagctttttttttttaacatacacaatagggatttgataagtttctgatggctgcaggcatgtaagagcatttcagtggtattgaatcaatgaagaattttgttgacatgtgaaatcttataaaaatattctttaccgaaggactgagttatgtggcagtgggtacattcattgtttcatccctcccctagtaactgggataaatatgttgatacatagtctctctgtttttctgcatttggaagctttcagaggaacataatgtagaggtgtttctttagcaaagtgcactgatagcaaaca

SEQ ID NO: 776 - DNA, 868 bp, Homo sapiens
  misc_feature (3)..(3): n equals a,t,g, or c
ggncacgaggttaactgtkacaccatgattactgaggtaagacatgtccctccagtcccgtggcagcaactgattttgcctatgcaaagccgtgctattcttctgctggtggttagcctttgctttagaggacttccctcctattccatgtgcttggaagtgatgagcagagggaagactttcaacgtaaatcctggtggtccatctggaccactgccaccaaccaaggtggtcacatggccagacagaactaatctgtgtcctaccccagaactgatgtagaaatgtccaaagtttaaagccttggctgggcgcagtggctcgcatgtgtagtcctagcactttgggtggccaaagtgggtasagcacttgagcccaggagttcaagactaaaacctgggcaacagcgagaccctgtctctacaaaaagtttaaaaattagctgagggtggtggtgtgcacctgtagtcgtagtaytcaggaggctgaaatgggaagatcacttgagcccagaaatttgaggctgcagtgaactaaaaaggtgctatggtaytctagcytctagtctgggtgacaaagcaagaaccctgtctcaaaaatcaattaaaaaacaggccaggtgttggggcttgtgcctgtaatcccaacactttgggaggccatggcgggtggatcacctgaagtcaggagttcgagaccagcctggccaacatggtgaaaccctgtatctctactaaaaatacaaaagttagccaggcatgttggtgcatgcctatggtcccagctactcgggaggctgaggaaggagaactgcttgaactcaggaggcggaggtgcagtgagctggaattgtgtcactgcactccag

SEQ ID NO: 777 - DNA, 657 bp, Homo sapiens
  misc_feature (12)..(12): n equals a,t,g, or c
cccccccggggntgcaggaattcggcacarattttacatgcttttaagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaaaaaaaaaaaaaaaaaaaaaaaaaa

SEQ ID NO: 778 - DNA, 1112 bp, Homo sapiens
gccggaggaagagcgtctgcaaaactgggttcctagaagtatagacggacttagcttttwgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagmctggacaattcacctatactgtgtaggaaattacctccttaattacctggtmgaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaaaaaaaaaaaaaaaaaaytcgag

SEQ ID NO: 779 - DNA, 1304 bp, Homo sapiens
  misc_feature (1)..(1): n equals a,t,g, or c
nctggtaccaaagcaagtttttcactgagctctcatgaaagatcctcagtctcttgtggatttagaatcctgcagcagcccaccatctaagagcaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttc

SEQ ID NO: 780 - DNA, 1113 bp, Homo sapiens
ggcacgagcggggacggggctaagatgatatctgggcacctcctacaagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtaaaaaaaaaaaaaaaaaaaaaaaaaaaaaaaaaaa

SEQ ID NO: 781 - DNA, 738 bp, Homo sapiens
ggtacaggactgagaagcagataacaagagtgacgctcacagggctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacgggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgatggagaaaaagtgtgaagatgcttaatggtgttttgaggcatccctccaacctctgtgactactttatccatgaaaatgaagcaatggcaggtgggaggctcttcccaatgtgctttcttcaaaaaaaaaaaaaaaaaaaaaaaaaaa

SEQ ID NO: 782 - DNA, 946 bp, Homo sapiens
ggcacgagcgaaagcctctctcttaacaacggtgccgcacagctttgcccttgaaagcatctctactggaccggaacacactcatgtgccccgctccctgacccagccaaggctgccctttcatctccaaggctgagatgttgccggtggtcccatgagagcctgcccatgggctcaggtgcccctttaccttctgctggatggacatctggctgtgagccaggctggggtcatggccggggtgagcggaggcaggggtggacggaggcttcgagggcccatcactagtagggtcattacctcttgccaacagccgggggtgggagtctgggtctcgctcaggccagagcttctcaacctggagtccctgggggtggctgccaaaggtgtgtatgacaagcacgtatccctggacatttccggggagaggtctggggctttggtcacattctccaagggctgctgggcttcggagcagtccccccccatgtctcagccactacagggtccctctctctccttgcaccccagaccctccgctgccctggtaatgagcagaaggaaagtcttggggtgtgctcaaagtcaggagagcaaaatatgccaggcaaaagctcccgggaaaagccggaggagtctggggtggccaccgggatgtggagcagcgagggcaaagacggtgaacacagccctccagctgtctgagcctcagttttctaatctgtagaatggggatgatcatacctgcctcacaagaatgttgagacaattcacagagacgttctggagcccctttcccccgagaccggcattcatgagtctgctgggaccagaaaacccatctcaggggcccagcggggcacccaggagagtctggcggtgcaagcgctgtataaaccacaagcgttctccaaaaaaaaaaaaaaaaaaaaaaaaaaaaaaaaaa

SEQ ID NO: 783 - DNA, 1949 bp, Homo sapiens
ggcacgagatctacctggaatgaacaagaatgaacgccagcctcatttcatgggttttggttctccacaggatctgcctcggtctgtcagacattcctaaggaaaattgtataataactatttcgggaatgcagttatctcatcatggtcagtctttggggaagtgggctgagaaattacatgtgttctattctctattttcattcctattgtgaccttcacaccgactcaaaaccttccttttagatacttctggatataaaaatatatgttaattttggggtttcacactcctgagtgaaaggcagtgtcatcaagtacgtgaatgcccagctcctaaatgtctttctcgttctcctcccacccagtcacgtcctccaggcagtgaccttcctttatttcacattccgcttacttccttgacccctcagcatttcagacctgaaaggacactggtactgttgtccttgtcggggcctgtggctttgcctctcattccctggtgaatgtcaggaaatagagggctgagactaatttttataggttctcaatttttcttgcttggggacaagctgttgacttagctctgaataggagtaataaggaggcagtgggccaggctgcatgacaactggttttcaggcccatataaaaaagtactaactttattatctcaagccatgcctggcctattgcaaagcccagtgtgggtgtcttggggcttgtatttgagattggagcttctctgacctccagtaccctttcctcaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaaggagcaggtaggtagggcatgtggtccttccctcccgtttcaaagacaaggaaagtgagtcacagagtagtgcactggcttacccaggacatacagtggcagagccaagactggagcctagctgcttgtactaaccatgccagtgccaccattaaccccaagtcactagtggtagctacttctgactatgactgtagtcactgtctcctggagaggagcctggccaccagattgatagtcccagctgagactctctcctgaactgataagctgttttgcatgcttggaatgcctttccccagtttgttcacctgataaactcatccttatcctcaagattcagcccagaagacacccttaaaggaagccttggctgtccttcccacccagtgttccctcactgacttctgttgctgctcacactgcattttacctgcttgcctccttccatgtgttcccagctagccagtaaattctttaaagacaagcattgtaccctttgcctcagtgtgcccagcaccaacctggcacatgctctattcatgttttccatgagtgtttcatgttagaggtgtattttgtacacaggttttatgctgggggctcagagagaagtggacagcagattgttggccctcccaggaagaaaagtcccaacgagctggtggatgatctctttaaaggtgccaaagagcatggagctgtagctgtggagcgagtgacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcatacccagcagtccagtgcaacgtctcctccatagctctgggttcttagatcttggttggacgtttgttttctccttagttgcatttcctgggtttttgtgatgatcaatggactttaatgaaaaaaaaaaaaaaaaaa

SEQ ID NO: 784 - DNA, 1481 bp, Homo sapiens
ggcacgagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaaaaaaaaaaaaaa

SEQ ID NO: 785 - DNA, 1505 bp, Homo sapiens
gcaccatggccacgcccctggaggatgttggcaagcaggtgggtaggtcttgtctgcttcctgtggccctgatgggtccctgcagagcctcacgctgcttgtcgctccttgtcctcttccctccaggtgtggcggggcgccctgctcctggcagactacatcctgttccgacaggacctcttccgaggatgtacagcgctggagctcggggccggcacggggctcactagcatcatcgcagccaccatggcacggaccgtttattgtacaggtaatgaggtgacatctcaggctgcagggaagtagtcaccttcacaaagcatgcactgactgtataaaaaaagaggcagaggcaatggaaattggatgttagctgctgttgattttgccatcctggtcccctggccctctccactctccattttttctcagtgacatcaaaatgacccagcaatacgcactcagcagcagcagcgtcacccagtggctataaggccattgagcttcaggaggtgcctagcgcccctgctggtacctctctccccactcctgagaaagagcaaatatctccaaaaacaggaggaatatacccttttagaagcctttgaaagcaagtttattatttttttcctgggtatagaagccttgcccattctttgtaggaggtttttaaaacagtacataaaaattactcataattttacaatccctagattgaatcaacaatatgcaacttatgggtcacctcccgtgtgccactcatttctagatgtaggaggccctgcggtgaatggagctgactaggcactgccctcagggcgcttacgttgtaagaatctcctccaaatgatagctgaaatcaagctgcagcagcactgtattctgctgaaaatgttgaaaaacatttttaagagcattttcttttttaaatatgtatatatttagggggtacaagtgcgggtttctgatgtgcagctatattgcagtgatgacatccgtctgggcttttagtggaccttccactcaaatagtgracattgtacccaatagggaagctttaatcccccacccctyccaccgtgtcaccttytggaatccccagtgtctgtgtttccactcagtatgtccatgtttacccattgtttagctcccactcataagtgagaacattttaagagcattttctcatgccattaaaaaattattatataggccaggtgcggtggctgacatctgtaatcccagccctttgggaggctgaggcaggcagatcacctgaggtcaggagtttgagaacagccaggccaacatggtgaaaccctgtctgtactaaaaatacaagaattaaccagatgtggtagcggcgggcacctgtaattccagctacttgggaggcttgaacctgggaggcagaggttgcagtgagctgagattgcaccactgcactccagtctgggccacagagtgagactctgtctcaaaaaaaaaaaaaaaaaaaactcgag

SEQ ID NO: 786 - DNA, 1051 bp, Homo sapiens
gcgcggccctccccatgtgcagccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctcctctatcagctcagcgggggaccccctcgcttcctgctcgacctgcggcagtacttgggaaattccacttacttggatgaccatggaccacctcctagtaaggtactacctttcccaagccaggtggtgtacaacagggtaggcaagtktgggagccgtactgtggtcttgcttctgagaatcttgtcggagaagcacggatttaatttggtcacatcagacattcacaacaaaaccaggcttactaaaaatgaacaaatggaactgattaaaaatataagtactgccgaacaaccctatttattcactcgacatgttcatttcctcaacttctcaaggtttggaggagaccagcctgtctacatcaacatcattagagaccccgtcaaccggttcttatccaactattttttccgtcgctttggagactggagaggggaacaaaatcacatgatccgcacccccagcatgaggcaggaggagcgctacctggatatcaatgagtgtattcttgaaaactatcccgagtgctccaaccccaggttattttacatcattccgyacttkkgtggacagcatcccagatgcagggagcctggtgaatgggcccttgagagagcaaagctgaacgtgaatgaaaacttcctgctcgtggggattcttgaagagttggaagatgtgctgctgttactggaaagatttttacctcattacttcaagggsgtgctcagtactacaaagacccagagcacaggaagcttggaaacatgactgtgacggtgaagaagactgtcccctctcctgaggctg

SEQ ID NO: 787 - DNA, 3282 bp, Homo sapiens
cccacgcgtccgacttaaaagagaagctttagctgccaaagattgggaaagggaaaggacaaaaaagacccctgggctacacggcgtaggtgcagggtttcctactgctgttcttttatgctgggagctgtggctgtaaccaactaggaaataacgtatgcagcagctatggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaatattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataaccgtgctggtctccgacgtcaataacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgaacagcgaggcgctgggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaatttgtgaaaaaaaaaaaaaaaaaaaaaaaaaaaaa

SEQ ID NO: 788 - DNA, 1787 bp, Homo sapiens
gcagtgttgcacttttctacaattttggaaaatcttggaaatcagatccagggattattaaagsracagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaawggtgaattttacagtctttttttcaacacttttattamcaaaagtaaacatggacagaacacactgcccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaarggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagrcaaaatwatggcatttaactaaagatggagcatgatctgtgtacatagcacatgtgaataaaagaaaagctgacagtataaaaaaaaaaaaaaaaaaaaaaaaaaaaaaaaagggcggccgc

SEQ ID NO: 789 - DNA, 838 bp, Homo sapiens
  misc_feature (19)..(19): n equals a,t,g, or c
  misc_feature (22)..(22): n equals a,t,g, or c
  misc_feature (81)..(81): n equals a,t,g, or c
gaaattaccttcacttaanggnacaaaactggactccaccgcgttgcggccgctctaaactagtgratcccccgggctgcngaaattcggcacgagtcggcacgagtcggcacgagtgagaagtgattgaaacaaaacagatgagttaatgtgattgagaatgacaggcagatgaagggggactcaagctatgatggtccctggaatgagagggtagatgggtttttggtggcctgggcccttcctattcaccttcatggcccccgaaaggcttagctctcttcccaggggctgctcccaatgtcctaagatgcagtcatgagtggggcttggggatcggggtttgcgggggcactgtggtccatgggtctgtgtgcaagttcagtttggggaaactcatgggacatagatttttgtcctagagactcacatggtgagtggtagccattgatggcaaaaagttacccggacttgaaaagatcagacagagtgagtgctcaggaaaataaaacgatgaagccaagaaaaagatgaaactaaactagaatgattgtggctctcctttggtgtttgcaagaggggccttccctccgtttgactggtgaggccttcccactctcgggctggtagagggacttcttcctggcttttgggggcaccggctcccccatagattctcgggtgcatgagcacaagttctgggcagattttgcaaaatcctgaagttaaagcatcttctgcttagaataaggaaagcaagtgaatgtcacgtttgtcacactaagacagttaccatgaaaacaaccacaggcgaaaaaaaaaaaaaaaaaaaactcga

SEQ ID NO: 790 - DNA, 1217 bp, Homo sapiens
cgttacacatgacaccagtgcctttgtttcattgggctgggctctctggaaggtgtgctgctgcctgagctgctggaaaagcactgacaggtgtttgctagaaaagcactcctggagcttgccaccagcttggacttctagggactttcctctcagccaggaaggattttgatattcatcagaaatacctccagaagattcaaggagctgtagaggtgaagtaagcctgtgaaggaccagcatgggaatcctatactctgagcccatctgccaagcagcctatgcagaatgactttggacaagtgtggcggtgggtgaaagaagacagcagctatgccaacgttcaagatggctttaatggagacacgcccctgatctgtgcttgcaggcgagggcatgtgagaatcgtttccttccttttaagaagaaatgctaatgtcaacctcaaaaaccagaaagagagaacctgcttgcattatgctgtgaagaaaaaatttaccttcattgattatctactaattatcctcttaatgcctgtyctgcttattgggtatttcctcatggtatcaaagacaaagcagaatgaggctcttgtacgaatgctacttgatgctggtgtcgaagttaatgctacagattgttatggctgtaccgcattacattatgcctgtgaaatgaaaaaccagtctcttatccctctgctcttggaagcccgtgcagaccccacaataaagaataagcatggtgagagctcactggatattgcacggagattaaaattttcccagattgaattaatgctaaggaaagcattgtaatccttgtgaccacaccgatggagatacagaaaaagttaacgactggattctatcttcattttagacttttggtctgtgggccatttaacctggatgccaccattttatggggataatgatgcttaccatggttaatgttttggaagagctttttatttatagcattgtttactcagtcaagttcaccatggccgtaatccttctaagggaaacactaaagttgttgtagtctccacttcagtcagaaactgatgtttcagctaggcacagtggtacatgcctgtaatcccagctacttgggaggctgaggtgggaggatcacttgaactcaggagtttgagagcagccagggcaacacagcgagaccctgtctcaaaaaaaaaaaaaaaaaaaactcga

SEQ ID NO: 791 - DNA, 3963 bp, Homo sapiens
cttgtttctgttttctttagattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgaaaaaaaaaaaaaaaaaaaaaaaaaaaaaaaaaaaaaacaaaaaaaaaaaaaaaaaaaaaaaag

SEQ ID NO: 792 - DNA, 2015 bp, Homo sapiens
  misc_feature (828)..(828): n equals a,t,g, or c
  misc_feature (2007)..(2007): n equals a,t,g, or c
  misc_feature (2009)..(2009): n equals a,t,g, or c
ggccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtatttkggattgttggaatnacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggartttggtmacgtaactagatggartcttgggatactgctggctttactctacctcatattaaaacttttggaattttttgggcatctgagaactttcagacaggttttacgaatattttttacacmaccmagttatggagtggctgccagcaagagacagtgttcagatgtggatgatatttgttcaatatgtcaagctgaatttcagaagccaattcttctcatttgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattcaaaaaaaaaaaaaaantnactcga

SEQ ID NO: 793 - DNA, 2683 bp, Homo sapiens
gggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagtgttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaatacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagtttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaaaaaaaaaaaaaaaaaaaaaaaaaa

SEQ ID NO: 794 - DNA, 1407 bp, Homo sapiens
gaattcggcacgagggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggcggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcckgtaatcccagcactttgggaagcccaagtgggtgaatcacctgaggtcaggagttcaagaccagcctgaccaacatggggataccccgtctctactaaaaatacaagccgggcgtggtggcgcatgcctgtaatcccagctactcaggaggctgaggcaggaaaatcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttaaaaaaaaaaaaaaaaaactcga

SEQ ID NO: 795 - DNA, 744 bp, Homo sapiens
ggcacgagttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaaaaaaaaaaaaaaaa

SEQ ID NO: 796 - DNA, 541 bp, Homo sapiens
  misc_feature (420)..(420): n equals a,t,g, or c
  misc_feature (486)..(486): n equals a,t,g, or c
  misc_feature (530)..(530): n equals a,t,g, or c
ttcaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaagggagaagataccctttctctcataaaaacacttagagcaaactaccactattaaatcacttattgcatactgaaaaaaaaaaaaaaaaaaactcgaaggggggnccggtacccaattcgccctatagtgagtcgtattacaattcactgggccgtcgttttacaacgtcntgactgggaaaaccctggcgttacccaacttaatcgccttgcancacatccccct

SEQ ID NO: 797 - DNA, 1044 bp, Homo sapiens
gctaatctcaacgttttaagaaagtttatgaatttgtgttggactgcttcaaagccatcctaggccgcaggttggacaagcttgctttatacctcatagttagagaaggtaatatttagcaagcagagttgttaaagaggaaggccttggctactcaggttatatgacagataggattcatttaggtcaatgcaaggatccaggggagagaacctctgtttacttcatttgtctccccatctcaaaaggactaatatccttgtaaataggagtgtgcagagctgtttgagaacactgctcgtcacttccaaaccccacaggctgaatgatgattgccctcctgatctctaagaaatggagtatgttagggcttaggcctggggccctttatcttctctgtcttcatctcttcttaggtgatctcacccagtaccatgctgtcaataagctgatgactcccaaatctatatatccagccctggttcctctctgggctccactcaacatctcctccccaaccttcctcctctcaatgaaaagcactcaaatgcccagttgctaagaccaaaaacatggtatgtctcactttccctcacctcccacatctaatccatcagcagttcctgtcagttttacatctaaaatactgtgtacctgaatttgaccactcctcatcattcccactcctaccaccatatatttcaggtcatcttccccttcctggactgttgcaatggtctcttccccccgtctctgcttccattcccatcccccaacaatatattctgcacagaactgtgagagatgatcatacgaaataatataaggtttgagatgtacttcaaaagaatttgagaaatagggggctagatgggtatagagatgaaaagattatccatacaatgataattattgaagctgactgaaaagggtacatggggttcatgatactattttctctactgtgtttgtttgaaattttccataataaaaaaagttgaaggaaaaaaaaaaaaaaaaaaaaaaaaaaaaaaaaaaaaaaaa

SEQ ID NO: 798 - DNA, 841 bp, Homo sapiens
  misc_feature (836)..(836): n equals a,t,g, or c
gaagggtcggggagatatttccgttagacatcgctgaaacacagactgggatcaaactgtgctcatagtcctaaggatctccagcaccctgccggtggcactactgagagacgaggtgccagggtggttcctgaaartgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatgggtaactggctcagcatcctcttccctcctagtcactctcagagaccattctcgagcctccagcaggacagaccctttggagttcccaaacgtcactcaaaaactaccagaggacccaccggccaaattccttcccaccgctccccctccccccaataactgtatctgggtaatccccactctgacctcaccttttaaccaactatttctggctggaagtggccatccacatccgtctactacccagaccttctgcctagacacagcttttgcaatgtcctacgaggaagtgctcgtgtaacctggtctaattaattttcttcatccctgttaaaggactgaatatgaagaaatgtccttgaattacaacagaaggaaatatggttggacttagagattagtttaaattcttgaactgataaacaatagaaggtagtgaagctcggtcctggaaaggcatttcaattagggaaaataaaacaatgctgctttggttgtgctaagaaaaaaaaaaaaaaaaaaaaactcgtagggggggtcttggtacccaatngtcct

SEQ ID NO: 799 - DNA, 998 bp, Homo sapiens
ggtgtcctgcccgtttttgtccttaatggccgtgttgattcgataggaatcgacagatgggagccaagaggggacgtaaccacttgccagtgtggcccagtatttatatggtagaagctcgggctggcattgagatggaggtgggaaagaggagggtgtctcgtgtttaaagatttctctcttgtgtggtccttggttatggctccccatggtgcttgctgctcccttggtcgcctttccttgcattttgctttttgcctttagtccttctgcagtcagggaccatgttggtgactctcggtcagatgttcccatatttgcatgtcttgctttggcctctctggctctaggttctgtattgctagttgctttctgacattttttctcattgtttgtgctaccttggccaagaacctctttgccttctccctcgtttgtaacattgagatcctagtagcagttacttcttagggttgttaggatgacatgagatgggcgagttggccatctgccacacaagagttcccttctcactgccatcctctgcccagggtgttccccagaatctgcagggccccattggtcatcttgctgtctgcacaccttcctctctcacctcttggcacttccctcaaaaaagagagaagtggagcacagtaaataaacgccagcgttttctccagttcccagcacctctccggaactggatcccccaaactcctctgtcactttctgtgtccagcgggcccctggggtccttcactgtcttcactctgctcagcctgtgcgcttggccttggtgctgtagggactgttataagagctgctgtccgatccccatattcaatctcacagccccactttgtgtacacacaccagagccatcttcttaaaatcagatcctgtcactcctctccctaaaatctaccagtggtctaataaaatcttgaatttttagcataaaaaaaaaaaaaaaaaaaaaaaaaaaaaaaactcga

SEQ ID NO: 800 - DNA, 643 bp, Homo sapiens
tttttttttttttttttttttttttttttttttttttgggaatgagaaaataactttattttcattgtggggagcgggccgatgtccagcctcagaacttctggaactgcttcttggtgccggcagccttggtgaccttgagcacgttgaagcgcactgtcttgctcagaggccggcactcgcccactgtgacgatgtcaccgatctggacgtccctgaagcagggggacaggtgtacagacatgttcttgtggcgcttctcgaagcggttgtacttgcggatgtagtgcagatagtctcggcggatgacaatggtcctctgcatcttcatcttgggtcaccacgccagagaggatccgccctcgaatggacacattaccagtgaaggggcatttcttgtcaatgtaggtgcccctcaatagcctccttggggtgtctttgaagcccagaccgatgttcttgttagtaacccgcgggagcttctccttgccagtttctcccagcaggaccctcttcttgttttgaaagatggtcggctgcttttggtaggcacgctcagtctgaatgtccgccatcttctcgtgccgmaytcctgcagcccgggggatccactagttctagagcggccgcaccgcggtggagc

SEQ ID NO: 801 - DNA, 882 bp, Homo sapiens
  misc_feature (522)..(522): n equals a,t,g, or c
  misc_feature (752)..(752): n equals a,t,g, or c
gacsmtctagaactatggtcccccgggactgcaggaattcggcacagcggctgcgggcgcgaggtgaggggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgaytccgatgtcgacgaktttctggacaaktttctcagtgctggcgtgaagcagagtgacyttcccagaaaggagacggagcagccgcctgcgccggggagcatggaggagagcgtgagargctacgactggtccccgcgcgamgcccggcgcacccagaccagggccggcagcargcggancggaggarcgtgctgcggggcttctgcgccaaytccagcctggccttccccaccaaggagcgcgcattcracgacatccccaactcggagctgagccacctgatcgtggacgaccggcacggggccatctactgctacgtgcccaaggtggcctgcaccaactggaagcgcgtratgatcgtgctgagcggaagctgtgcaccgcgtgcgcctaccgcgacccgytgcgntcccgcgcgagcacgtgcacaacgccagcgcgcactgacttcaacaattctggcgccgctacgggaagtctcccccacctcatgaagtcaagctcaagaatacaccaattctttctgcgcgacccttctg

SEQ ID NO: 802 - DNA, 2443 bp, Homo sapiens
gccgccgggggacgcggagcccaaacgccgctcaccgcttgcgggcgccgggcatggggagtgtggtgtgagcccgcacccggggaggacgcaggagctgcggagacgggcgcgaggaggaggagaggagtcgtggattggaaggacccgagggagggagggtggggaagcgagggaaaagtgaagctgggaggagaaggcggcggaaggtggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaaaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctatgtccagataccctcagttttgattggtcaatggatgctgtgcctctgctcaaaacagtttgtgactggagaaacctacacactgtggccttctatactggactccttctccttgcctactatggtttgaagagcccgagcgtagacagagaatgcaatgggaaaactgtaacaaatggcaagcagaatgcaaatggacatagctgcctttcagatgtggagtaccagaactcagagactaagtccagctttgcatccaaagtagaaaatggcattaaaaacgatgtatcacagagaacccagcttccttctacggagaacattgttgttctgtctttatctttgttaatcataccctttgttcctgccacgaacctgtttttctatgtcggctttgtaattgcagagcgagtattatatattcctagtatgggcttctgcctactgattacagtgggtgctagagccctttatgtcaaagtccaaaagcggttcctcaagagcttgattttttatgctacagctacactaattgttttttatggactcaagactgcgatcaggaatggagactggcagaatgaggaaatgctttatagatcagggataaaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctaccctggcttctgcatatttaaataccggtattattctaatgaaccaaggaaggacggaagaagcccgacggacattcttaaagtgttcggagatcccagatgaaaacctaaaggaccctcatgcacacaagagctctgttaccagttgtttgtacaacctaggaaagctgtatcatgagcagggacactatgaggtctggccaatgcctctctgtccttttccctcccccttgttctgatccagtctcagtggtttgtaacctacagcctcctttgagcctatgtcctttgaacaactaatatgtatacacgttaaactattgtcctttgagaaactaatacatgatgacattggaatggttttttgatcaaatttgtttagaaaaagcttctgctaaataaaaatttaatagatttcaaaaaaaaaaaaaaaaaaactcgyagggggggtcccgtacccawtcgtcctctcrtgagta

SEQ ID NO: 803 - DNA, 920 bp, Homo sapiens
taattcggcagagctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcaraggtggggtgcgggcgaggggacgatgcattatttttaatatttgatttatttttccaactggacttcttcccggggctctttctgggcccagctgcctttgtgatcccgcgccccggtcctcggcctytcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgyttgaccccatctttgagcccggccccaagctctgggaccgtcgtgcccctcatcaaggaagagccaaggaccccaaggagaagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaaaaaaaaaaaaaaaaaaaaaaaaaaaaaaaaaaaaaaacggcacga

SEQ ID NO: 804 - DNA, 883 bp, Homo sapiens
  misc_feature (8)..(8): n equals a,t,g, or c
  misc_feature (28)..(28): n equals a,t,g, or c
  misc_feature (30)..(30): n equals a,t,g, or c
  misc_feature (47)..(47): n equals a,t,g, or c
  misc_feature (873)..(873): n equals a,t,g, or c
aaaatagnaataactaaaaggcgaattnanccctctagatgcatgcncgacacggccgccagtgtgatggatatctgcagaattcggcttatcgtgaacctggctttggtggacctgggactggcactcactctccccttttgggcagccgagtcggcactggactttcactggcccttcggaggtgccctctgcaagatggttctgacggccactgtcctcaacgtctatgccagcatcttcctcatcacagcgctgagcgttgctcgctactgggtggtggccatggctgcggggccaggcacccacctctcactcttctgggcccgaatagccaccctggcagtgtgggcggcagctgccctggtgacggtgcccacagctgtcttcggggtggagggtgaggtgtgtggtgtgcgcctttgcctgctgcgtttccccagcaggtcttggctgggggcctaccagctgcagagggtggtgctggctttcatggtgcccttgggcgtcatcaccaccagctacctgctgctgctggccttcctgcagcggcggcaacggcggcggcaggacagcagggtcgtggcccgctctgtccgcatcctggtggcttccttcttcctctgctggtttcccaaccatgtggtcactctctggggtgtcctggtgcagtttgccctggtgccctggatcagtactttctatactctccagccgtatgtcttccctgtcactacttgcttggcacacagcaatagctgtctcaaccctattgcctatgtcttaagccgaattccagcacactggcggccgttactagtggatccgagctcggtaccaagcttgatgcatagcttgagtattcatagtgcncctaaatagt

SEQ ID NO: 805 - DNA, 999 bp, Homo sapiens
  misc_feature (30)..(30): n equals a,t,g, or c
  misc_feature (88)..(88): n equals a,t,g, or c
  misc_feature (90)..(90): n equals a,t,g, or c
  misc_feature (948)..(948): n equals a,t,g, or c
  misc_feature (969)..(969): n equals a,t,g, or c
  misc_feature (983)..(983): n equals a,t,g, or c
  misc_feature (986)..(986): n equals a,t,g, or c
ccccaggctttaactttaaggcttccggcncgtaagttgtgggaattgtgaccggataacaatttcacacgggaaacagttatgaccntngattacgccaagctatttaggtgacactatagaatactcaagctatgcatcaagcttggtaccgagctcggatccactagtaacggccgccagtgtgctggaattcggcttgycaccaacgasttcatcctcagcctgacagccaagctggatgagaatgaatggggctctgtgaggcatcttgcagctccctcgacaatgctctgcccgtacactctgttctcgtggtttctgtctcctcttctgtgtttacagggttgggcagctgctacagcccttgcctcttccctgagtgcctcagagtgacagagatgaagaagccacttggctctaggaagtgtggcctggctttgatatggtttggctttgtgtccccacctaaatctcatctggaattgtaatcccccatgtgtagacggagggaggtgattggatcatggaggcagtttcccccaagctgttctcatgatagtgagtgagttctcacgagatctgatggttttataagtgtatggaaagctcctcctttactcactcttctctctcttgctgccttgtgaagaaggtgactgcttccccttctgccatgattatgagtttcctgaggcctccccagccatgcggaactgtaagtccattaaagctcctttgtttataaattacccagtctcaggtatttctttatagcagtataagaatgaactaatacagtgtgagaactaatacagtctgaggatgaactcgttggtgacaagccgaattctgcagatatccatcacactggcggccgytcgagcatgcatctagagggsccaattcgccctatagtgagtcgtattacaattcactggccgtcgntttacaacgtcgtgactgggnaaaaccaggcgtanccnacttaacgccttg

SEQ ID NO: 806 - DNA, 1191 bp, Homo sapiens
taatacgactcactatagggaaagctggtacgcctgcaggtaccggtccggaattcccgggtcgacccacgcgtccgcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgtttttgtttttgtttttgtttttgttttgcacagcataatgttaattcagattgttgaagctttcttgtagttatttatttatactcaatgtatgtattaaagaatgaacaatgtctcaagaacaaaaaaaaaaaaaaaaaaaa

SEQ ID NO: 807 - DNA, 1011 bp, Homo sapiens
ccacgcgtccgctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaaaaaaaaaaaaaaaaaaaa

SEQ ID NO: 808 - DNA, 1915 bp, Homo sapiens
ggcacgagggcggctggctctcagtcccctcgctgtagtcgcggagctgtgtctgttcccaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaagatacaaagttagccaggcatggtggtgcatgcctgtgatcccagctgctcaggagcctggcaacaagagcaaaactccagctcaaaaaaaaaaaaaaaaaaaaaaaa

SEQ ID NO: 809 - DNA, 1669 bp, Homo sapiens
gctccaggctgtgcttctctggagcccgcragggscacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcamggtgaaccttctcatccccgtggcgtacttggtcttctgggccttcctgctggtcttcagcttcatctcagagcctatggtctgtggggtcggcgtcatcatcayycttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatgcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgttttaaggaagccctaaaatgtggactgggtttcctgtcttagcactgccctgctagctcttcctgaaaaggcctataaataaacagggctggctgttcgctcgtgctatggggagtccctgatgggcacagacgggagtggctggggcgtacctcggtgggtgcacacatgttgctggccaggaagatgccgtggcaggccctggaggaggctcttgacattagggggctttgctgcttgacacaggcgctccctaccatggcacccagagtccccctgccctaaagggatgtcgaggatggggtagcagctcagtccgcccctaccccaggcccctcgatgccagtctgagctcggccacccaggagagctcaggggctccaggctgggattgtctttcttcccgtaaatcaccacagagtgaaggtcaggacttcagagcccacagtctcaccctggcttacaggtggggaaaccgaggccctgagataggatggaacagacgtggccactgctgttggtgcctcggcctctctgtccccagaaagcacagagcagcatgtcctgggggctttgaggcctgcagggaactccaggggcttcatgtacagcaggcacacaccccagcccttccacggtrcccaggagattggaccttcagggagggcaaagggcgcctgcctggccaggggcatgagggtttggcaggagccacccaacccaggtcctccagaggccttgctggacaggaasagggtgaggcgtgagcaaaatagtcaccacggatgagacccagcgtccccatggcccggccccatcctcatgacaactcccagctctaggggcagctgttgccactgcagggcagatgaagcaaaaaggctctggtcccctgcttctctggaaatgggttcccagaatggagtggggggagagaagtgagaccccagggtgcttgtgtacaatgggaccctgca

SEQ ID NO: 810 - DNA, 752 bp, Homo sapiens
gaattcggcacgaggggattacaggcatgagccaccatgcccggccatataaagcatttaggatagttagttgctatttttatttatttattattgttgttgttattatattactactttatcccatttcacaaggatggcatgttgccaacattgtctttctaaagaatatctctgatcacatccttgttctattaaaaaccttttgaaagctccctcttacctttagaagaaattggaacttcatgattcctcatggtctggctccagcactgagtctggaatgctagtgtgagatgaggccttagaagtcatccagctgaactcctggaatttttatagatgaataaatgtagcatccagacatttttcytgttgcacccctgtamgccatgtcctcttccagactcctggataagactgrcagacatcaccattctcttaaaccagaactacacttgccttcatccatttgatcacctggttccaggtaactcatgagctttgtagcttcccttctctcagaccttccaaggaagacaatggcataattttccccatatgctctaattagcaacctttccctgcccttctgtgggtgggcagggccggacacagtgggtcacacctgcaacctgtaatcccagcactttgggaggctgaggtgggcagattgcctgagctcaggagttcaagacagtctgggtaacatggcaaaatcctgtctcaaaaaaaaaaaaaaaaaaactcga

SEQ ID NO: 811 - DNA, 1955 bp, Homo sapiens
ggcagtgtccccaaggcaccgaaaccgaggcgggggtctcggtccctccgcgcaaggagggaggcggaccgtacgtggcaggactcaccgccccgcacgtggcaggactcaccgccccgcgccgtgttctccgagccatggcgccagcgctgtggcgggcctgcaacggactcatggccgccttcttcgcgctggcggccttggtgcaggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcaggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaatattttcaatcaattttttataaacattaggggaacaagccaggaatttatttcaggtaatttgggctaatagttttaaaactccaaataactttttaagggtgcatataattcgatgtaagattggatgggacaagtaagaaatggtctgatattttccagacactttctgcagggtcttgtgtcataatgtagtggaaaaggctagaaataaagtttaaaaatacagttctaacttaactttgtactatgttatttgggcaatatataaacctcctggtggatattatctataaaataggataatgccagatctacttacttacacagtaacaaggatcaatctagataatgtaagaacactctgaagatataaagtgtttggaaagattacggagggctgcccatgattaaaatagaggggagcagggattggtaatatactgaaatagacattcaagagagggtataccccgatctttttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgtagaggcagggtttcaccgtgttgtccaggctggtcttgaattcctgagttcaagcgatctgtccaccttggcctcccaaagtgctgggattacaggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggactataactacattctaaatgagaaataaggtcaaaatctatatacattctttataaatggatgtccaaagtaatcctagggaggagagctttttttttttcatttccattttcatttaaaaatggatacttgattattggaaaacttacaattgtgtttggaacaacttgggtatttgaatctaattttccaattgcaaattttatgatacctaaatacagataaagtatttccaatgaaaatttagtgtccaaatgagtggggctataaatgtaaaatacactggattttaaagacatggtagaaaaagaacagaaaatattttttgtattgattacatgttgaaacaatattttggctataatgggttaaatatactattaaagttgaaaaaaaaaaaaaaaaaaa

SEQ ID NO: 812 - DNA, 2259 bp, Homo sapiens
  misc_feature (1919)..(1919): n equals a,t,g, or c
  misc_feature (1960)..(1960): n equals a,t,g, or c
gataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctattggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcartatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgkatctttttgcgtctgcacaatggctagcacatgtcagcatttgacaattgttaaatgataacaagtgtgccccaattaaaacgttttycctgggttgtttkgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatggggaatcctaaaactagtattgaactaaaactttgctaatgatctttattagaggatcgtccaactttycacnttaccytgggttttcttttccaattcactcttacactagtnctgcttatttcccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaaaaaaaaaaaaaaaaaaaaactcgag

SEQ ID NO: 813 - DNA, 2590 bp, Homo sapiens
ccacgcgtccgtgaagcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctgggctgctggtctcttctccttggcctgagctccctttctctgccggcagccatctcagccctgcagttgtctgttttcagaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagccttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaaaaaaaaaaaaaaaaaaaaaaaaaaaaaaaaaaaaaaaaaaaa

SEQ ID NO: 814 - DNA, 2879 bp, Homo sapiens
ggcacgagcttgtccgcaggtgcagtctggccccagcggcaggtcacaggacggggcagggagagccatggcagcccgtgggcgttctggagtggggccacctggcttcttgcgggccttggcgctgctccagctttcctgtgggttctactgggcctgcagtaggggctggatggtccgaggaactccccacccttgagcctgggcactggcccagctgtggtcagtaccagtttcctgtagatgctgccgcacagacagacagaggccccggggtccggccgcccatgcatagccccagaggggacagattctggcgaccagagttgctgggcagtcttgggtttagtgccgcaatgctgcacttctgacaggctgcttcctggatccctgcagggacctggccagggcattggccccaggtcacctgtggctttggggagagcagttgcagggctggcctgggctgtgggaggcagctgtgccgttttctgacagccattgggaccgccccagtacccgaagaggtggctgccctgagttgccacgggaaactgcagggtggccctggctcagcagccaaccttggggagacctggaggaacagtgcagtgtaaagatggcctcgcgctgagcgggtccccgcagtcggcactcccaggagaaccagcgggctgtgcatgtgacccgccagcctgcaccgcgggcacgtccttcccacccagaggaccctgcactgccttcagggccacagcagtcctccggggcccagcctcaggcaggaaacagcaaatgcttttgctgccaaccaagtgtggctgtcgctttcgatgatgccagtggcgctggtgcgactgccgggcagcatgtgtgggcggggatggctcggccactgaccgtctccccgcagtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcaggtaaggctgtgggactttgatctggccggagctgcagccgtagcaggtcactcccgttcctgactgcccagagctatggggcagctgggagaggagatgagtttgtggacgggacacagaggggcccacgggaagcgtgtgcaggctcaggggcagccccactgtgacggggaggctgggagcaggccaggaagtgctgggtccagtttgggagctccagggtctgcgggaggtaggtggtcgaggaggagactgctgtggggtctcacggtgccctatgccgaggtgacctgaccttcctcccgttgccggcctcgcccagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacgacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcaaaaaaaaaaaaaaaaaaaaaa

SEQ ID NO: 815 - DNA, 2421 bp, Homo sapiens
ccggctgatcgctgccgctccgccaatacaatagagccakccactaccagcagcctggccctcttcctccttctccagagagaccaatccagccgaactcggggtttgcctgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtraccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttta

SEQ ID NO: 816 - DNA, 694 bp, Homo sapiens
gcttagattttttaagtcctctcaaatttgtacactcagaactaagtatattcaaatgtagtctgatttgcatagagaatgacattttcttcattcagactttgtttttaatgaaacctgataccagtgattttggcagctgtaacaggctgtatgtctctttgaaatagacttttttaaaagcctagttgtttctcactgtcctgtgccattttgttgttattgttgatttttttgttctaagcttatgactttatatttatccttattaaatatgatccccttaaatttagcctcctgttccagccacttagaattacttaaaaagttgattatgtcatacagggtatttacttttcccatcccagatacctgtcatttgcacatttgatcgtcctcctttccatattctcatccaagtcatttataaaaaaatgttacaaaggacaggttgctctgggcccctgttgcatactactgagccttcttccagatttatctgcactctttaggtacagttgtatagttgtctgtgaagccacttaacttttaagttaaaaaattcatattttttcaccttgcacagtgatatcaagagagactttattttatgccttgctgaaatccagatactatatttatgcctctagcatttgctggcctaaccatataaaaaaaaaaaaaaagggcggcc

SEQ ID NO: 817 - DNA, 2763 bp, Homo sapiens
agagtttgaccctggaaaggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgyggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttagggaagaaaagttttctgcttttttatagaaaatcatttcagtctcccgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtytgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaaaaaaaaaaaaaaaaaaaaagggcggccgc

SEQ ID NO: 818 - DNA, 904 bp, Homo sapiens
  misc_feature (8)..(8): n equals a,t,g, or c
acccacgngtccggagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacaatgccttttaaaaatgttccatactgtattagcatccttagaagggacagaactaagaaatacattgctcaaataatattttactttattgataatgacaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggatacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaaaaaaaaaaaagggcggcc

SEQ ID NO: 819 - DNA, 1512 bp, Homo sapiens
  misc_feature (1)..(1): n equals a,t,g, or c
  misc_feature (1512)..(1512): n equals a,t,g, or c
ngcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttggggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacn

SEQ ID NO: 820 - DNA, 776 bp, Homo sapiens
  misc_feature (2)..(2): n equals a,t,g, or c
  misc_feature (13)..(13): n equals a,t,g, or c
  misc_feature (61)..(61): n equals a,t,g, or c
  misc_feature (79)..(79): n equals a,t,g, or c
  misc_feature (101)..(101): n equals a,t,g, or c
tnttggccccatngattttaccgcccaaagcttcttaattacggactccacttattagggnaaaagcttgttacgcctngcaaggtacccggttccggaanttcccgggttcgaccccacggcgttcgagggctcctttctcttgcctggaggggaaaacagaagattctggcttgagcttccctcatgctgccctattttaagtggctcctccacctggtgaggctgtcctttgtctctctggcttctccatgggacagcacagctggccttggcctgaagctccctaacatctatgggatgacatctatgggatgggatccctcacctggggccaggggaggggttggcacagagaagcgatgagatgggtctccaaggccaggtctcctttcatcctgagcaaagggctcagggctatgaaatgatccaagacatgaaacaaatattaaatataaaaatagagtccaaaggccaggcgcggtggctcatgcctgtaatcccagcactttgggaggccgaggtgggtggatcacgaggtcaggagatcgagaccatcctggctaacatggtgaaaccccgtctttactaaaaatacaaaaaattagccaggtgtggtggtgggcgcctgtggtccctgctactcgggaggctgaggcaggagaatggcatgaagctgggaggtggagtttgaggtgagccgagatcacgccactgcactccagcctgagtgacagagcaactccatctcaaaaaaaaaaaaaaagggcggccgc

SEQ ID NO: 821 - DNA, 712 bp, Homo sapiens
ccacgcgtccgctaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 822 - DNA, 838 bp, Homo sapiens
cccacgcgtccgccctcccctcactctctgttctgctttcatttcttggagtttcactagatatctcatataagtggaatcataaggtatttgtctttttgtgattggcttatttcatttagcataatgtcctcaaggttcattcatgttgttgcatgtaatagaatttcctttctttttaagggtgaataatatttcattttgtgtgttgagaggtaggacctttaaaatgattatgtcatgagggctctgccctcgtgaatgaattaatgacattaccatgggagtgggttcctgataaaagaatttggctcctttctctcactcttgtgcatgctctcttgcccttatgtcttttgccatgggatgttggagcaagaagtcccttcatcagtggtgagcccatcaaccttggatttcccaacctccagaactgtaaataaatttctttttaaattacccagtctttggtattctgttatagcaacacaaaatggactaaaacagaagattagagagactttcctctttgtacagttttctcaaatgccaaggtggcataaattggaatagtgtgtcctgaatctcattagagattcctcatggttgctctatgctatgccatgtagggagagaggggcacaaacaggtgtgcgacatgccacaagttttcctcctcctttcacaggaatactgtcttggttacaatggcctaggtgctattgcttcacagctagtctctatagttttgttttttaagagatgaggtttcactccagcctgggggacaagagtcgagattcgtctcaaaaaaaaaaaaaaaaaaaaaaaaaaaaaa

SEQ ID NO: 823 - DNA, 2020 bp, Homo sapiens
ccacgcgtccggggtgagggcaacagatgctggacccagggagctctctgccacaggatgatggtggcccttcgaggagcttctgcattgctggttctgttccttgcagcttttctgcccccgccgcagtgtacccaggacccagccatggtgcattacatctaccagcgctttcgagtcttggagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactacagacaaagagaaagctgactctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttctttccttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaaaaaaaaaaaaaaaaaaaaaaaaaaaaaaaaaaaaa

SEQ ID NO: 824 - DNA, 1193 bp, Homo sapiens
  misc_feature (1080)..(1080): n equals a,t,g, or c
  misc_feature (1186)..(1186): n equals a,t,g, or c
ggtcgacccacgcgtccgcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtgcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctggctctgagtacccctgctttgggcttgggcctaggctgcattgaaaagagctgaaggttgtggcctttgcgctcctggcccagcctttgttccccactggagcagaaggggagatggacgacacggtsggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaaaagccagtgcccagggatgggcatctccagggagctggggattagtgccaggnagccctgccagccatgcctacatccccatgggcacagaacaagccaaagccttcgttgtatgttgacgatgcacttttatgaaatgtagtttctatcgctgttttnagccttt

SEQ ID NO: 825 - DNA, 830 bp, Homo sapiens
ggtcgacccacgcgtccgctgaaaggaaaagcactgtttggagaatgatccacctttcaagattttacttattgttgataatgctcccacatgtcctcttttttacgggtgatcttcattcctaatatcaaagtgatatttcttcctccaggcaccacctctttgatccacacaatggatcaaggagttatagcagcttttaagttctactacctgagaagggaggacttttgcccagtcccatactgcagtggaggaagacactgagaagactctgatgaaattctgaacagcatcaagaaccttgtttaggcttggattatgtcgctaaggactgtaggaatggcacctggaagaagacacgcaagaggtttgtcaataayttcaaaggatttgccaaggatgasgaagttgcaaaaatcaagaargctgtggttgagatggcaaacaactttaacctgggtgtggatgtggatgacattgagtaattcctagagggggttcctgaggaattgactaatgggttgctgttggaactggaataggagtgcatagctgaagaagaggtaaagaaaaagaaagtgcaggagaagggaaaaaagaactcccaagaatactcacagtgatgggtttagcagaagcttcttcagactccaacaagctccttaagaagtctgaaaacatggaccccaaaactgaaaggttttcactaatagagaggaaagttcatggtgcattatctgcctacaagcaaaaccaggattcaaaaaaccctttgagctggagcttcaaagcacaaaaaaaaaaaaaaaaaaaaaaaaagggcggcc

SEQ ID NO: 826 - DNA, 765 bp, Homo sapiens
ccacgcgtccggtgaggtctcatgtctgcttatgcggtggctcgctgctcagaacagggaaccattggagatactcattactctttgaaggcttacagtggaatgaattcaaatacgacttatttgaggaattgaagttgactttatggagctgataagaatcttcttggagaaaaaaagactggtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaaaaaaaaaaaaaaagggcggcc

SEQ ID NO: 827 - DNA, 2126 bp, Homo sapiens
cgtccgcggacgcgtgggggatgaaattgccctggaacattgtgaatatactaaaagcaagtgcattgtatgctttaaaatggttgttattaattttatattatgtgatttttaccttaaaaaaagagaaaatagccttactctatacataataaactcaagatatgttacaaatttacatgtgaaatccgaaatactataatatttaaggaatagctaagtagaataacactgaaatttaacataatgaaacatttccttaaaaaagagaaaagcacagtaattaaaaaggaaaataatattttttctctccattaagcatgccattaactgagtaaaagaatcaagctgcaattatgtaaactacgttttctaaaaccataaagaaaagaagaaataaaaaggtatttgggaaaaaaatccaaaggtacagtcaactacacaaaaaaagcttagtctcattaatcattatgaaaatgcaaatggtaactgaaagaagataaaactacaattcaaagagaaagcctaaaatttcaaccccccaaaaagtctgggttttggagatctgggatggaatagggttcctaacctgacaacaatgaaagaaccaaactaacctcaaagtcatgactttatttttatagcaacgagttgccaagaactgagtcaaaatgtgagggaaaacaagcacctgcaaggagaaagaggacagatgcacttacatagggacagatgcaaatagacccactatgacaagtaaagctggaataatcaataaattcctaaagacaaagtggggctggtcagattgggagacggctgacagctgcagaagttgggaaagatccatcatcttgaaaactttttctccacaaacccactgtgatctctcaagcaattggtaaggaatccaagagagtctgtatatgacacagatcagggagagcagaacacttgggaggtgaccaggtcttgggggccgagcccttatgaatcggattagtgcctttataaaagaagctcaatggagttcttgtgtgccttccactatgtgaggacatagaaagaaggcaccatctatgaaccatgaaatgggctctcatcaacactgaatttgtgagcatcttgacctgagatcttacagcctcaagaagtatgaaaaaagaaatatctgttgttttttagtcacccagtttatgttattttgttataagagtccaaatagaccaagatattccacttaatatgtaggggaaggcaacaaaaactgccacacttagaatactcctgatgctgggagtatgaaaacaggaaaaacaaaaacaaaactgctcttgaaggtgaaggaggaatatcactgagctcaccaacacagccaggaaaagaacagaagtgtgagaaggctacattcctgagaccctgagaaaaagtaacctgcataagacagagatgaaattacctactctagttatgattgaaatcccaaaaagaaaacagggaaaaataatggagcaaaagaaatatttttcaaaataactgccaaaaatattctaaaagaagtgacagaaaatcaaacttcagatataggaaactcagagaatgtcgaatagaacaaaaagaaataagaattccatcttgaaaaatctttgaaaaatctttaaaaaaatcagtctaaattttatatcttgctccaatatatgagatataaataggttatcatcaagatatggagaaagccatattcatggaaacactaaaataaggctgtggaaggactacattgatattagacacaacagagttcggaacaagaaatagtatcagagatgagagacaatagataatagaataatcaattctcaagaagatgtaaacatcctactaattagggtatgcagctaacaacagagcctccaaatacgtgaggtaaaacacgaaagaaatcaaaggtgaactagaaaaatccaaaattatatttgcagacttcaacacttttgtcttagtaatggaaagactaggcacaaactcagtaatcatgtggaagataagaacaacagtatcaccaacaagacatccaatcttcaatggcagatactctttcctttcaagtgaaaaaaaaaaaaaaa

SEQ ID NO: 828 - DNA, 1824 bp, Homo sapiens
ccacgcgtccggaaactttgctggatttatttatcaggtctaggagctttttggatggtctttaagtttttctagatatataatcctatcatcaacaaacagcgacagtttgacttcctctttttaaatttggatgcactttatttctttcctttatccaattgctctggctacgacttccagtactgtgttgaatagaagtggtgaatgtgggcatccttgtctcgttccagttctcagggagaatgctttcagcctttccccattcggtatgatgtttgctgtgggtttgtcatatatggctttttttactttgaggtatgttccttctgtgccaattttgttgagggtttttatcatacaggaatgttggattttatcgaatgctttttctgcatctggtgagatgatcatatgatttttatttttaattctatttatgtgatatatcacattgacttgggtatgttaaaccatccctgcatccctagtattcaacccacttgatcatgatatattattatctttttgatatgctgttggatttggttagctaatattttgttgaggatttttgcatctgtgttcatcagggatattggtttgtagttttctttttttgagacagctaattctttgttgtgaggggctgtcctgtgcatcatagaatgaccagcagcagcagcactgactgacaaaccaaaaatgtctccagacattgccaaatgtccccttgggggcaaaatttccatctgttaagaaccattggcctaatgcttggcacataataagtgctcaataaatattagcactgtgactgctattattatttttacagtttgagtatcccttacccaaaatgcttgggaccacaagtatttcagattttaggtttttttggattttggaatatttgcattatacgtcccagtttagcatctctaatctgaaatctgaaatgctctaatgagcatttcttttgagtgtcataacagcacacaaaaaaagtttccaattttggagcttttggaattggagatacccaacctgtaccttcttgaattgttgaattttctcccatgtgcatttgttacttttataataataaaaaaatactctcttgattgagatgaaaagtatcaaagaggaaaaagcaattagtcttcatccaggggaacaatgtataacgtgaaaaaataattgcctggcatttattgagtgattaccatgtgctaggtgctgtgctaaacaaaaacatacgttatctaccttaatcttcaacatctccttgagataagcacttctgtgctcctccgcccccatttcacagatgaagaaggtaagtcattgaatagttaggaatatttctcaggaatgtggttgctttggatgcatgttggtctataagaagtaaacatcttatgtactctatgtgtgtgcgtgtgtgtgcgtgtatgtgtgtatgtgtgagtgtgatgaggtatcactattttacctgggctggtcttgaactcctgagctcaagcaatcctcccgccttagcctcctgaggagctggaattacaggcacatactgtcacacctagttatgatatttttaatacataaatcacagaattttagacctagaatagattttaagagattgtctaaaaactattgttttatagatgaagaaactgaggcaggagaatagcttgaatccaggaggtgaagcttgcagtgagccgagatagcaccactgcatttcaacctgggcaacagaaggagactccatctcaaaaagaaagaaaaaaaaaaaaaaaaaaaaaaaaaaaaaaaaaa

SEQ ID NO: 829 - DNA, 826 bp, Homo sapiens
ccacgcgtccgaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagtgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagccggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 830 - DNA, 867 bp, Homo sapiens
  misc_feature (457)..(457): n equals a,t,g, or c
ggccgcccttttttttttttttttttttttttttttattggttaaagtgctgatgccagatgacccttgagatcccttattagtgaaatgttctgataataaagaagagtttggctcacctgctggtctccaccacacaggtttataaccaagagccctacagctcttgtcccaccctgagggcctgactgacctgtggagggccccacctttcgcctccattcactcacccctgttcccaagaaccactgacttctttacatgaagcctactttgagtaagtttttaggtacagatgctgaattacccaagctgtatccaccctcactccaggcaccccgaggagagactcaactgcttggcccagggttagagaggcccacacgggaaggcagagtggagcagatgttatttaaccaaaagtctgtatcctggggctcccagctaccacagtcangaaacacatttttaaaaaatcmagacccttgaactagcagcagtagtcacccataccgtatacgataaataaaagtaagccaatgtttattcttctttgcataaaatcacctataccaacacttatacattacagcatcattcagttaattcaagtctgaatcccagaaactctcctgaaatcaagccacagttcagccctattcttcctagtttttcctgacatacttttgcttactctataaatccacggatattcttcttgcctactcccaccaaagcccaaatacacgtgaaaaaagttaatcatgaagtttttcttattcccttacatttagaaaatcagcatctactctcatagactacttgtaagaagacaaatttctgctactccggacgcgtgggtcgacc

SEQ ID NO: 831 - DNA, 626 bp, Homo sapiens
  misc_feature (22)..(22): n equals a,t,g, or c
  misc_feature (591)..(591): n equals a,t,g, or c
acaacaaacatcgaaaatcgantatgtgccccgaaaagtcggaacgcaggcaatcagtccgcacgmgcgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctctttccaactcagtttcttgtttttcctcttcctcctcctcctcttcttcctcctttctttctcttnccccatgggggaggggttcattcagggaaaacagg

SEQ ID NO: 832 - DNA, 1540 bp, Homo sapiens
  misc_feature (22)..(22): n equals a,t,g, or c
  misc_feature (430)..(430): n equals a,t,g, or c
gcctgggcgccgtgggcgcggnactgcgcgggctgcgcgggtgccgaggagcgcgaggcgcggggaaggcgcacctggggtggccctggcgtgcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggaagcgggatgcctgggcctttkaagrtyaccggggctattcatgcagggcagccnggggaaggtccagcagctgcacagcctgagaaactccttcamgctgcccccgcacatcargctgyatcgyattgtggacaagatgcacgatagcaacaccggwatccgttcaagccccaacatggagcagagaagcacctataaaaagamcttyctcggctcctccctggtggactggytyatctycaamagcttcamgggcagccgtctkgaggcggtgamcctggcctccatgytcatrgaggagaacttcctcaggtctgtggctgtacgatgcatgggaggcattcggtctggggatctggccgagcagttcctggatgactccacagccctgtacacttttsctgagagctacamaaagawgataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatgaaaaaaaaaaaaaaaaaaaaaaaaaaa

SEQ ID NO: 833 - DNA, 685 bp, Homo sapiens
  misc_feature (7)..(7): n equals a,t,g, or c
gggcccntttgggggccccccctttttttttttttttttttttttttttttttttttttttttttttttttttggacaggaagtagaatttattggtgagtattaagaggggggcagcacattggaagccctcatgagtgcagggcccgccacttgtccagagggccacgactggggatgtacttgaccccacagccatctgggatgagccgcttttcagccaccatgtcttcaaattcatcagcattgaacttggtgaagccccacttctttgagatgtggatcttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagcctgtcagccccagcacaggacaacatcttgttgatgcggatgacgtggaaggggtggagccgcacccggatatggaagccatctttgccacaactttttaccatgtacttattggcacaaattcgggcagcctccagggcttcagaggacagctgctcatattcatctgacaccatgtggccacaaagcggaaactcatccacttttgcctttttccgccccaggtyaaaaatgcgaa

SEQ ID NO: 834 - DNA, 1046 bp, Homo sapiens
  misc_feature (14)..(14): n equals a,t,g, or c
ttgcaggaattcgncacgagcactagtagctggtgytccaggctggcggcgctcacctttctcctagccgggtgacccaggggatttattttatgttggctttctctgaaatgccaaagccacccgattattcagagctgagtgactctttaacgcttgccgtgggaacaggaagattttcgggaccattgcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaaawaaaaaaaaaaaaaaaaaaaactcgtag

SEQ ID NO: 835 - DNA, 1220 bp, Homo sapiens
  misc_feature (404)..(404): n equals a,t,g, or c
ttttttttttttgagatggaatcttgctcttgttgtccaggctggagtgcaatggcacgatcctggctcactgcaacctctgcctcctagcttcaagggattctcctgcctcagcctcccgagtagctgggattacacgtgcccaccaccacgcccgactaatattkgtatttttagtagagacggggcttcaccaggttggccaggctagtcttggaactcctgacytcgtgatccacctgcytcggcytcccaaagtgctgggattacaggtgtgagccgtcttgtgttttttgtttttgtttgtttttaaaagatggartttcactcttattgcccsggctggaktgcaatggcacratctcggctcaccgcaatctccacctcctgggctcaagcaattnttctgccccagcctcccaaagtgctggaattacaggtgcccgccaccatgcccaaccaattttcsgtaytcytagtagaggtggggtttcacaacgtkggccaggctggtytcaaactcaaaytcctgacytcaggtgatctgcccactttggcytcccgaaatgctgagactagaggcgcgagccaccacgcctggcctacaaacacattcttgtttgggtttttatataaaatatgagcacaaaaatactttccctaaatacagcctctggctttgcctaacccttggcacacasccaagtacctcttccattctcagatacgtgaggggagtgtatagaggtttagagtacatacgtttcttctccaactcttcgtcgtctagaagaagactaaccacctctttgggtttcaaggtatctggtttgaagttcccacctgaaatcaccatccgctgaatctcactcttctccttggctctttgcagaatgcgttcttcaatggtgcctttacagatgagccggtacacagtaacctgctttgtctgccctaagcggtgggccctgtccatggcctgctggtccacagtggggttccagtcgctatcatagaaaatgcactgtgtctkcagcagtgagattgatacccagtcctccagctcgtgtgcttaacaggaacacaaagatgtcattcctgttctgaaaatcagcaaccatgtctcgcctctccgagatcttggatgagccatcaagcctyatgtaggtatgcttcctgtaaaccatgtattcctccagtaggtctatcatcctcgtgcc

SEQ ID NO: 836 - DNA, 1025 bp, Homo sapiens
ggcacgaggccggaaagcagaaggttgcagtgaagctgagatggcgctactgcagtccagcctgggcgacagggcaagactccacctcaaaaaaatatataaaataaagtgggattcatccaagagcttggacatgattaactagtgtcaaggagatatgtttatgccattattatcctccttacttggtagggtacaacagaaacagaacaacaaggtgacagccttttgctcaagtcaaaaagaaaataagtccctcatcttaggtttaaagttgttcattcaggtagtacagacttgcatttggaagacttattcttgatcttctgtagctttgacagcaaggacatcactacaatgggtacagaaataacacattctgatccttgctgagatccttgtatgggcctatcttaaatctagcctattgtctgtcttaccctttgatttttataagtggaaaacaggaaaaggctaaccaagcaagaggaaggcatagattcatcttcctttcaatcttgactatagtttaaagagaataccatgatctttctgttctattcttggcttacttgaatatttagccaggtctctgcatcttattcagtcagaaaacagacacagattcagataactcaaaggatgttacttgcttgagtaatccttgggcctcgctttaactttgtagatccaggaacagaattaagcagacagttcggtctacactgccaaatttcttagggaaaaagagggcaagtcagaaggaggaagttggcatttggctcaaatgaccaaattatttaaggtctctacacttcactttgcaccaagtagacccaagaatgattataattcagctacgtgtggtggtgcagatcagtagtcctagctattcaggaggctgaggcgggtggattggttgagcccgggagtttgaggctgcaatgggctatgatctcgctgcgctttagcctgggcaacagaacaagaccctgtctcaaattaaaaaaaaaaaaaaaaaaaaa

SEQ ID NO: 837 - DNA, 721 bp, Homo sapiens
  misc_feature (623)..(623): n equals a,t,g, or c
  misc_feature (626)..(626): n equals a,t,g, or c
  misc_feature (638)..(638): n equals a,t,g, or c
aattcggcacgagccaggttagccggaagggcagctctccaggccctgcccaccccacagggggctccttatgcacagcggggcgtctccttgtggccatagaaacggaactggctcttttcaacagtgctgcaagaggatggttatttaacgctggcccccaaggaggaaaggcacagacyttcctccctcctggaacatccaagggcactggatcctctgtgtccctctgagatggggtgccactccagcaagagcaccacggtggcagctgagtcccagaagcttgaagaagagygcgagggaagagagccaggtctggagaccggcacccaggcagcagactgcaaggatgccccgctgaaggatggaacccctgagccaaagagctgaaatgcctctctccagagtcggaccctcacctcyttcctggaactgcctttggccccagaaccatgagacaatccccaccctgagaagctccgatcactgggaggagagagaaagcctccagctttgggattcaggcttcagaagtttttagcagcctttgctcattggagaggtggggaaaggataaagttcttataaggaaatccctaatttcccccagctcctccccnccngaagaaggaacnaaagaaagttccttccacacgttttgttggaaacttttcccttgccaactttccttggattgccagaacaaagccctccagaa

SEQ ID NO: 838 - DNA, 778 bp, Homo sapiens
ggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgcacaggttcttctgtgacaccgagagatctaacccaaggcctgggttatgtcttagtcgagacatcatcatctgagaagcaccacatcctttcagacacatcctcggacacacatgcggtccttggtgcccccaggttcaatcctgcgttagctcttttgatgagaaggaaataaaccaaaccagccacttgcactatggcttccaagccaatgttattgactcaataagtgcttagcaattggcttcctcttttgtcttcctattttcagctccatttaaaccaggagttatttataaagacctcttcctctcaaaaaaaaaaaaaaaaaaaaaaaactcga

SEQ ID NO: 839 - DNA, 2160 bp, Homo sapiens
ttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtgcatattaatactcgaaagtgccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtataaaaaaaaaaaaaaaaaaaaaaaagggcggccgctcgcgatc

SEQ ID NO: 840 - DNA, 666 bp, Homo sapiens
agacttgcctacaaaggagaccactaatcactagcatgctgaataaacatgaaagttaacttaaacattaatttacttattatcaaaagcttatctgcttctgctggtgcaatgaactctgaatgggaaattgccagtggtgaatggtagataggtgaatggcttcaagaaagtgtgctctgtgctttggcaggagcagggctaagctgagacatggtcctagtggcccatccatgggctargcaggaatgggtgggaagagggcaggggaggcttccccggggcctgcagattgtgttcttaagrgttttttccttcagtccttagaagctcagctgaaaggaatgactgcggccggatgtggtggttcatgcctgtagtcccagcacttagggaggccgaggtgggcagatcacctgaggtcaggagtttgagaccagcctggccgaactggtggaaccccaactctactaaaaatacaaaaattagctgagcatggtggctggtgcctgtggtcccagctgcttgggaggctgagccagaggaattgcttgaacccaggargtggargttgcagtgagcccagatcaagatcacaccactgcattccarcctgggcaacagarcaagcaagattctatctccaaaaaaaaaaaaaaaaaaaac

SEQ ID NO: 841 - DNA, 1208 bp, Homo sapiens
  misc_feature (161)..(161): n equals a,t,g, or c
ttcagaggaaaaataagttctgtatatgttttagctaaatagtattatttttgtcatattcccaaattggaagtcccagtacatattagcctattacaattctaagttatttgcagtaaagaatatagatgaagctggtctcatttctattttccaagtknytgggggccatagtgatttttttttaacctgacaacacctcagggaaatttatggtttacagagcacaacattgtaaattatggcaaagtaaaaaagaaaacactgaatttcaacttggaaaatcagaatgctgttgctaatagtattagtagcaaatatattaagtatgtcaaatatgtcaaatgctgttgtaagtgatttacatatattagtacatttaatctcacataaagcaaattaagtaatatcattagctccattctacagatataaagaccgagactcaggtraattaaggtactcacccaaatttacatagcagaactgaaattcaaacttatgcaattagtctccagtctaagattttaactgcactgttattctgtcgctgttacctactaattgggtwacctgtggcaagctattttaccyctctaagtcaagctgtttattgatcagacagattaakgttwtctgawgtggskgtcmtaaggratcagtatttaacagagtcaaatgcagtgcctgaaatatgcagttggtactcataatamttatttattaaatgagaytcaagaactctagatttggttatcytcctagctgtgwamacacagctatttgttacctatcgttattagaggaacaggcataaagctgtgctgagytgcttgacggaaaattcccactctagaacttcaactggatctttagaactaatcattaatcttggatttacccaggttgattgcccattgcaactcataccacaggcatttcacgtactgtatgcattcctcaaaccagggcagggggatcaggaaatgatttaaacccgtcaactgaggagccccaggaggaccatgcactggctgccctgacattttaccaaatgtggctgtcctgtcatgatcttttcttaagaatccctacgtaattccaaagctaatattwaaatatacgtaaatacctctatcttcactctgtatcccttyacttctaggctctggctccatcaaccattccatcatccttttgagtttccc

SEQ ID NO: 842 - DNA, 1281 bp, Homo sapiens
agcgtcactgaccagaaggacctgtggcagattccagaaaaggtctccctataagaagctgctgtcctccctataacttatggcactgcgatttttgctcttgagcattgggcccgtacccagcctgggtaatatagctgctgctggaagtgacgagaagtgcaagctggcgatgcagaggggtgcgcagtccagcgtgaactacagtcagggcagcctgaaggatgcagcatcagcatcaacgagaacagcaagtgggtgggtgaaaaggaatagaagcagagaaaatcaggaaatgcttatatatagcaaaaacaaaatacccatctggaaaatatccaaaaaatgactgcagactctcttagttggcaatgccaaatgctttagaaattattcatgtgttaaattcagttatgccagttctcactaactactttatatccatgtctgtggggaattcttgcagagggcattgttcagctattagaattactggggtggcagttccccttttcccagttcattgtggaccaaactacaggctcttctgatcttactgctttctgaagcagccagcagcgtagataattccttgacttgttttatttaaaaaatatcactggagatttagtaggagtgttgtatcacaccaattctcattctgttttcaaccaaggattctggagtactctgatagcattggtttcatttctcatgtcgtcctggcaagcataattttgtagtttatctcagtttcaggtagaagctgcagaagcagagagcagcctacccacaaaaggggtccagttggttctctagcccctgagctgagtggcaggcagtctatatgtttgctcatctctgcactgtgcctggtgctgtgcttagaggagaagcaaaggaaggagcgtgtagtccaagtggaaagccaggatagacagctggtaaaactcgcccatctcttgccttccttcttgccttctggataattgtgtttttgcaatagcttctcatttcccttctaaagaagaaaagcaaaaagcaaaagccaaacaaatatacacatattttatatcaaagatgtttgcaaaagttgtttctgtaactcattgcttagcaatggtaccgtaggggaattttcatactgggctacagaatacttatgcatttttgtagtttatttaaaattctctaaagaggcaatgtgttaaaggaatcctaaagtaagtctttgtataaagcaaatggtccttccctcaaaaaaaaaaaaaaaaactcgag

SEQ ID NO: 843 - DNA, 1152 bp, Homo sapiens
  misc_feature (1145)..(1145): n equals a,t,g, or c
agttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcmatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggaaaaaaaaaaaaaaaaaanactcgag

SEQ ID NO: 844 - DNA, 1357 bp, Homo sapiens
ggcacgagtttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggactgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaaaaaaaaaaaaaaaaaaaaaaaaaaaaaaaaaaaaa

SEQ ID NO: 845 - DNA, 1258 bp, Homo sapiens
tgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattaaaaaaaaaaaaaaaaaaaaaaaaaaaactcgtagg

SEQ ID NO: 846 - DNA, 1526 bp, Homo sapiens
ggcacgagaaaaaaccttcaggcggcccatgggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccctttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaaaaaaaaaaaaaaaaaaa

SEQ ID NO: 847 - DNA, 1258 bp, Homo sapiens
ggcacgagagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaacttggtggttttttttttttggtttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccctgtgtctgccctggctctgtctcctctgtgacagggcagagcatttctggtcagtttctccatggtgcctcccaccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattctaaaaaaaaaaaaaaaaa

SEQ ID NO: 848 - DNA, 1269 bp, Homo sapiens
  misc_feature (1263)..(1263): n equals a,t,g, or c
tcgacccacgcgtccgggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggctccacagtgtgcacagatgaacgarttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataaaaaaaaaanaaaaaa

SEQ ID NO: 849 - DNA, 1037 bp, Homo sapiens
  misc_feature (6)..(6): n equals a,t,g, or c
ggcggncccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacacctgatgaagccgccgatctggaaaggcaaataggtaacactgaaagtctgcccatggcctctggtcacttcccgcctgggcccagctacagtggggaaggcaggccgagggctktgcaggaggagctgascgctgggaaggaaggaggccagaagtcagcgttccttagctcgctgggtgggcaggatgagctgaagaagaggtgtgatataaggctggagggacaggtatcctggaggcaggactgcaggcccacttgagcaaagcatcagtgtgagctgtgcttctgatgtttctttgaaacccaagtgtttgattccactctactaagcagcctccaccccgagagattacagttgtaggttgctgcccttactcccttttgcaatccttagagcatgaccagtttccatgatataaatctaggaaagttacatcttaggcagctttcttgtttatccaggccaggattgagaatttcctttatttaggtataataaacatgtatctgtgatatgtattgagatgaatagctttatttttccttagatattaaaacctatactaaagtttattacaacccattttgaagatattaaaacagatcctaatcccttacacaataaacttttacagtttttttttttaaaaaaaaaaaaaaaaaaaaaaaaaactcgag

SEQ ID NO: 850 - DNA, 1651 bp, Homo sapiens
ggcacgaggtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggaccccccccccgggcctgcagaagggtggtgtgctcccaggactggcatgacaggtgtctcctcctcaccacaggctgtgcccatgagtccctgtgcagaccagtgggcaaggcagctggccagatctcaggccagccgtttgtgctcctagcagggttgctgtgctggccacacggagaggccctagagagcctcatggattgtaactaaagaagaaacggttcctttatgtttttttaaaaatgatttttaaataccgttttttcaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaaaactgcagttttcaataaagattgacttgtgttgcaaaaaaaaaaaaaaaaaaaaaaaaaaa

SEQ ID NO: 851 - DNA, 1679 bp, Homo sapiens
  misc_feature (1656)..(1656): n equals a,t,g, or c
  misc_feature (1664)..(1664): n equals a,t,g, or c
gcagcgcacccgggcgatcgcttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgaaaaaaaaaaaaaaaaaatnrctgcggnccgacaagggaattc

SEQ ID NO: 852 - DNA, 840 bp, Homo sapiens
ctcaaactcctgagctgaagcgatctacctgcctcagctaggattacaggtgtgagccaccgcacccaacctcaataagcktatttgataaaakatatgcaagctccctttatkcacttttcattcagaatgtttagtaatttgtattgtttttcagattttcagcccaatatatctccytgcccactgtgtcactgtattctacctawacatcatcacgtgtttctgctattggctgtatgatggaacactgcggctcattttcctgaaaactgccgatagtgcatagartgctgggatggaaaccagaarctttgaattcaagccttggttctgccttgtttttgcttgggtggccttgagtcagccacataccttttaaaatctcaatttattagaaattattccaaatcaaaatcaaatgagaaggtatatacaaaagtgctttatcccacaataaactattcaagagagagcaaaggagaggacatttactcaacacctcctaaaaggcagccagtgaaattaggcattttatttaatcctcctggcaactctgagagtaaagcattattaatcccattttggctgtttaaagaaattatttgcactagattccagctgtagtttagyttcagaaaaaaaaatcctgagatgtgaattcacagctttctgggtttaaagcccaagctctatcacatcatgctattattgttacattactgctagttctatgaaaagaaatactaatttatgaaatacatcttatccaaaaaaaaaaaaaaaaaactgggagggggggcccgtacccaaatcgccggatagtgatcgtaaacaatc

SEQ ID NO: 853 - DNA, 1364 bp, Homo sapiens
tctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtmtataccttcctatccattggcaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccaaaaaaaaaaattaaaaaaaactggagggggggcccggtac

SEQ ID NO: 854 - DNA, 1344 bp, Homo sapiens
ggcacgagcgccagataactcaactttcccattggctacctttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccagctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaatgagaaaaaaattacataaaacagatgacatgtatagaaataaaaaaatagaatggaggaactaattccaaatatataagtaatcctaagtggactaaatttgcaaagtaaaaggcaaacattacactggattaaaaaacaaatccagggaatacagtttacagctgatacattcaaaatataaaaacagataaaatataaataaaatcggtacagtggtgtctgcctgtaatcccagctagttgggaggctgaggcaggaagaccccttgagtctaggagttagagaacagcttgggcaacaaagcgagactgtctctaaaaaaatacacacacacacacacacacacacacacacacacacacacacacacacacacacacacacacacacacacacacacagactgaaatggaaatgagccgagatcgcgccactgcactccagcctggcaacagagtgagactctgtctcaaaaaaaaaaaaaaaaaaaaaaaaaaaaaaaaa

SEQ ID NO: 855 - DNA, 2071 bp, Homo sapiens
cggcacgagccaaaacaaaaattttgtgcagtcctgtcatttaatcatcttatcagtgccccaaggtgacttttttcaagagctctgttgataccatgtgtgtgtgttattttctggtgtttttacagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctccttatttttttttccctaagcctccgttcactgtctctccctctccctttctctttccatgttgcactccacagagaacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcaataagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattggttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaaaaaaaaaaaaaaaaaaaaa

SEQ ID NO: 856 - DNA, 2118 bp, Homo sapiens
ttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacatygcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctytggcatccatttttccaaagaagagtcgagtcctctgaggtctgtgcttgaaarccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaaaaaaaaaaaaaaaaaactggagactag

SEQ ID NO: 857 - DNA, 1213 bp, Homo sapiens
  misc_feature (1172)..(1172): n equals a,t,g, or c
  misc_feature (1210)..(1210): n equals a,t,g, or c
agcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaascagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagctagaaaaaaaaaaaaaaaaanctygagactagcggcacgagggggggcccgtacccaanacg

SEQ ID NO: 858 - DNA, 1963 bp, Homo sapiens
  misc_feature (335)..(335): n equals a,t,g, or c
  misc_feature (1959)..(1959): n equals a,t,g, or c
ggatcctcgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgcatggckttggcgttggcggcgctggcggcggtcgagccgcctgcgcagccggtaccagcagttgcagaatgaagaagagtctggagaacctgaacaggctgcaggtgatgctcctccaccttacagcagcatttctgcagagagcgcagcatnattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcacctttaaaaaaaaaaaaaaaaaaaaaaaaaaaaaaaaaaaaaaaaaaaaaaaaaaaaaaaaaaanaaaa

SEQ ID NO: 859 - DNA, 3886 bp, Homo sapiens
  misc_feature (1050)..(1050): n equals a,t,g, or c
  misc_feature (3743)..(3743): n equals a,t,g, or c
  misc_feature (3848)..(3848): n equals a,t,g, or c
  misc_feature (3877)..(3877): n equals a,t,g, or c
  misc_feature (3882)..(3882): n equals a,t,g, or c
  misc_feature (3885)..(3885): n equals a,t,g, or c
gcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgnccagaaggtactacataaggacaagtcattagagaatctcggcatgctcaggaacgggggcctcctcttcagaatgaccctgctcacctctggaggggctgggatgctctacgtgcgctggaggatcatgggcacgggcccgycggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcrttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagcaaaaaaaaaaaaaaaaaaaaaagggcggccgctctagaggatccaagcttacgtacgcgtgcatgcgacgtcatagctcttctatagtgcacctaaattcaattcactgggccgtcgttttacaacgtcgtgactgggaaaaccctgcgntacccaacttaatcgccttgcagcacatccccctttcgccaagctggcgtaatagcgaaaaggcccggaccgacggcctttccaacagttgccaacctgaaggcnaaagggaccccccctggacggggcataancccgnggnt

SEQ ID NO: 860 - DNA, 1201 bp, Homo sapiens
ccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgaaaaaaaaaaaaaaaaaactcgagggggggccc

SEQ ID NO: 861 - DNA, 1083 bp, Homo sapiens
aattcggcagagccctgaaccccgcaccccaccctcgaggccagaaatcggttgcctctggggacctgagaagcgagaccactcggcgccctgacttgcaaagttggggtctttattggcctccgggattctgctcctggcggtttctccaggctggtgatgggcaagccgggtgtaccaagtccaggatgcacatgaggagcgtttgtagcagtcactgaatcacctcatgactagcggggcaggcctctaattcaccgcaggatttccggtaggttggattgtggggttggtgtttgcactccaaagagktgctgtgatttccctgtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacaaggttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaactcgag

SEQ ID NO: 862 - DNA, 1580 bp, Homo sapiens
  misc_feature (1513)..(1513): n equals a,t,g, or c
  misc_feature (1542)..(1542): n equals a,t,g, or c
gctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactccaccagttatttcccaagtgtttgaaatgcaggtgtgtgtctgaatttggatctaatccacttaaaggaggnctgtggaggggaaattccttttttgaggncgggttttgggtccccttgcccggggaaagggttcccg

SEQ ID NO: 863 - DNA, 1157 bp, Homo sapiens
gagatggattttcttccaaaaatgcagacccattttaattaagtttgtaattaaccactggggagggcaggccccctggattcggtctgctttcggagacactatgggagtcatggccatgctgatgctccccctgctgctgctgggaatcagcggcctcctcttcatttaccaagaggtgtccaggctgtggtcaaagtcagctgtgcagaacaaagtggtggtgatcaccgatgccatctcaggactgggcaaggagtgtgctcgggtgttccacacaggtggggcaaggctggtgctgtgtggaaagaactgggagaggctagagaacctatatgatgccttgatcagcgtggctgaccccagcaagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtaraggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctggcaaaaaaaaaaaaaaaaaaaaaaaaaaaaaaaaaaaaaaaaaaaaaaaaaaaaaaaaaaaaaaaaaaaaa

SEQ ID NO: 864 - DNA, 2643 bp, Homo sapiens
ggcacgaggcgcgtctcaaaaggatggtgcgcctggcggccgagctgctgctgctgctggggctgctgctgctcacgctgcacatcaccgtgctgcgcggctcgggagccgccgacgggcccgacgcggccgcgggcaacgccagccaagcccagctgcagaataacctcaacgtgggaagtgacaccacatcagaaaccagcttttctctctccaaagaagcaccaagggagcatctggaccaccaggctgcacaccaacccttccccagaccgcgattccgacaagagacggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactacaagtacgacagtacctcagacgacagcaacttcctcaacccccccagggggtgggaccatacagccccaggccaccggacttttgaaaccaaagatcagccagaatatgattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccaggaattgaagacacttttaggacagctgccaccgaagtgagtctgcttgcgggaagcgaggagtttaatgccaccaaactgtttgaagttgacacagacagctgtgagcgctggatgagctgcaaaagcgagttcttaaagaagtacatgcacaaggtgatgaatgacctgcccagctgcccctgctcctaccccactgaggtggcctacagcacggccgacatcttcgaccgcatcaagcgcaaggacttccgctggaaggacgccagcgggcccaaggagaagctggagatctacaagcccactgcccggtactgcatccgctccatgctgtccctggagagcaccacgctggcggcacagcactgctgctacggcgacaacatgcagctcatcaccaggggcaagggggcgggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccagggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtgaaaaaaaaaaaaaaaaaaaaaaaaaaaaaaaaa

SEQ ID NO: 865 - DNA, 1076 bp, Homo sapiens
  misc_feature (979)..(979): n equals a,t,g, or c
  misc_feature (1007)..(1007): n equals a,t,g, or c
  misc_feature (1040)..(1040): n equals a,t,g, or c
  misc_feature (1050)..(1050): n equals a,t,g, or c
gcccaaggagctcagcttcgcccgcatcaaggccgttgagtgcgtggagagcaccgggcgccacatctacttcacgctggtgaccgaagggwgcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtsytccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctaygcatcttccccccactgcggtgttcggcctgaaggtggtgggggtgagggggggtttggccattagcatttcatgtctttccccaaatgaagatgccctgcaaagggcagtnaaccacaaaaaaaaaaaaaaaaaaaacntggggggggggccccgttaaccattttggcctnataggggggnggtttttaaaaattaattgggcccgg

SEQ ID NO: 866 - DNA, 1348 bp, Homo sapiens
gttaaaaaacatgtaaaaccgtatttatcttcgaattacagtgttatgtgtttgaatggttttagatgttaaaaagtagcaaattgaaacttaatgtttaaagtctttgttaattgaaaaattgatcttcaatagtggtactatttgcagtatgattcgttcctttaatgtacatacgtatatattagtacatacgagagtgatgttagacctgtagaaatgaaggtgttgttttaattgaaaacatttatgtttattttgctgatagtgtttgtattttcaaaaagtaaacaagttctgtcaatatgtttgaaaatttttaaagttgagataaatagcatctcattttgtaaaaataaaaaatataaagatttaccatatgcgtttgcatcagaaaagactggaaggacatactcaaatgtcaacaatgattatctctgaatatgggattatgggcagatttttatattctttttacttatctgtattttcaaaaacttctacagtaagtgaactgcatttataatactgttttaaaagattgaaccaccaaagatagaggttattaaaaattatatccctactcacatgattatagtaattggattatttttggatttcaagaaacattagtattagtttaagagaatgttgctatatgtaaagcattgtactaaaaactatgggagatatacagaaggaaaagatagcttactttcaaggaagctgtatttcaaaaaatgtgtgtagaaagtgccagagtggcaaggaaatttgctcaccagttatcccactccttaatacagtttcctggcaaatctttgtttctttcttagactaatacttggagacctatgtctccttgtactcttctttcaaatctaactttgtttttttaatggatcatgaaagataaatttctgtaattgatgttttattcatagcatgaagattttcctctaaactgtttcttccttttctggtaatcatttacagtggtctttatgttacaatttgaaacacagtagaagtacaaaaatatggccaggcgcggcggctcacgcctataatcccagcactttgggaggccaacgtgggtggatcacttgagctggggagttcaagaccagcttggtcaacatggtgaaaccctgtctctactaaaaatacgaaaattagtcgggcgtggtggcacatgcctgtaatcccagctgcttgggaggctgaggcacgagaatcgcttgaacatgggaggtggaggttgcagtgagccaaggttgcaccactgcactccagcctaggcaaccaagcgagactttgtctcaaaaaaaaaaaaaaaaaaaaaaaa

SEQ ID NO: 867 - DNA, 559 bp, Homo sapiens
  misc_feature (3)..(3): n equals a,t,g, or c
  misc_feature (9)..(9): n equals a,t,g, or c
  misc_feature (35)..(35): n equals a,t,g, or c
  misc_feature (42)..(42): n equals a,t,g, or c
ccntgattncgccaagctcgaaattacccctcacnaagggancaaaagctggagctccacgcggtggcggccgctctagaactagtggatcccccgggctgcaggaattcggcacgascacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaaaaaaaaaaaaaaaaaactcgagggggggcccggtacccaattcgccctatagtgagtcgtattacaattcact

SEQ ID NO: 868 - DNA, 1336 bp, Homo sapiens
ggcacgaggtccagccaagttatctaccctcaaattctggactaatcatgtttgtgctttgggtatttaaaattacatacatatatattctttttgccaaaaacaaaagtcttgcttcttgtcaaatgattgctaaagtagatcttacattttttgttattatgtatatatttatacacacccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaacctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattttataaattttttagggtttttctcgttgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttataagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgttaaaaaaaaaaaaaaaaaaaaaaa

SEQ ID NO: 869 - DNA, 1460 bp, Homo sapiens
gaattcggcacgaggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaacttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaaaaaaaaaaaaactcga

SEQ ID NO: 870 - DNA, 982 bp, Homo sapiens
  misc_feature (360)..(360): n equals a,t,g, or c
gaattcggcacgagcatatgtccaagtgttaccttgtctagcccccaggaacacagtccccaggaccatgttttttggggcacccacagcaggggcagtgcaggtctggttgctcctgctctcacctgcagcatctcccgtagaggaattgtcagttctggttccctgtgggcagtaaaggtttccttgtaggtcactggggcattggccagaaaaaggttgtgaaaatcacatgctaatttctcaaaattcctgctttcaatgttgatgtccaataaagatgttcataatttcagctggatattcttaataggatttcctccaataccgatgctgtaaagcatattgaatggaacaggnattcaaatttgaaactctctctctagaagggtccatgtgggagatggtggatcacttgaggtcgggaattcgagmccagactggscaacatggtgaacccccatctgtactaaaaattacaaaaaattggccaggagtctaggcatgtgcctgtagtcccagytactcaggatgctgagcccrggrgaattgcttgagcccaggaggcagatgttgcagtgagccgagatcactgccactgtactccagcctgggtgacagaatgagactccatctaaaaaaatttttaaatttaaaaagttgacacacttttacaagctgcatcccatctcagataaggaggtgatgtaactgagttcttttagatccatctgctttcatcttatctttttgtaggtaatattttgacaagcatgtttgtacataaagattctcctatggttgggattttaaaaattcatagactactcaggccaggtgcggtgcctcaagcctgtaatctcaacacattggaaggccaaggagggtggattgtctgagcccagaagttcaagaccagcctgggcaacatggcaaaatcctgtctctacaaaaaatacaaaaaaaaaaaaaaaaaactcga

SEQ ID NO: 871 - DNA, 1282 bp, Homo sapiens
  misc_feature (115)..(115): n equals a,t,g, or c
  misc_feature (433)..(433): n equals a,t,g, or c
  misc_feature (1021)..(1021): n equals a,t,g, or c
  misc_feature (1030)..(1030): n equals a,t,g, or c
  misc_feature (1042)..(1042): n equals a,t,g, or c
  misc_feature (1046)..(1046): n equals a,t,g, or c
  misc_feature (1056)..(1056): n equals a,t,g, or c
  misc_feature (1066)..(1066): n equals a,t,g, or c
  misc_feature (1069)..(1069): n equals a,t,g, or c
  misc_feature (1104)..(1104): n equals a,t,g, or c
  misc_feature (1110)..(1110): n equals a,t,g, or c
  misc_feature (1112)..(1112): n equals a,t,g, or c
  misc_feature (1125)..(1125): n equals a,t,g, or c
  misc_feature (1130)..(1130): n equals a,t,g, or c
  misc_feature (1133)..(1133): n equals a,t,g, or c
  misc_feature (1191)..(1191): n equals a,t,g, or c
  misc_feature (1228)..(1228): n equals a,t,g, or c
  misc_feature (1231)..(1231): n equals a,t,g, or c
  misc_feature (1244)..(1245): n equals a,t,g, or c
  misc_feature (1255)..(1255): n equals a,t,g, or c
  misc_feature (1281)..(1281): n equals a,t,g, or c
ggcacgagagaaaggccagtttgtggggcaaattagactaaactctgtgctggtagaactgctttccaagaatgctgtcactgctatagtttttaatgcttcaaatctcaactcnctccctccattcgccatagctcaaccatgttccaggagtgtattccaatcagcttgttttytcttaactggtcaaaggaatgttgctcattcacctgccccaactcacatattaacaattgtttaactgggattagataaaaggaaagctgacttacagatgaaccaagagggagctatttatgccacagcccccagcccagtaactttatgtttctgatctcctgcaaaatttttttataaaaaaagcttagccaggaactagtagaaagaataaagtaaagatggtgtaagaaatatatggataggcaagttccwnygytgagaccttaygaagaatggtgaggtgtggttaaatggaggagataatcagcagataawagctcagatggtcmsaaacatwtagaactataatgccatctccaaagtattgcatgcatacaaatgacgttcaatccgttgaatataatggagacacactatttcaaaaattaagttcttctwtcttgagctttaaaagtatacacatttacccmaatgaattwaaaacatgcmcacmaatatttatatcaaaagtgtacatgatttccaaaacttggaagtwaccaagatttacttccwtgggttagtgcataaattaactgtgatacatatatactatggaatwttaytcagcaacagaaataaatgaghtatcaaaccacagaaagacatggaggaaacttaaatccaggtggmtaagtgawagaagccaatatgaaaaggctacattstatatgatttcaaatatatgacattcaggaaaaggcaaggctgcagagacagtaaaragatcagctaggtgcatgkggstcacgccactttgggaggcttgaggcaggkggattatmttgaagtcaggagttcnagaccagcntgggcaacatgntganaccccatatntcctaaaagnacnaaaatttaactgggcgtggtggcacgtgcctgtantcccancnactctggtggctnagacnggngaattgcttgaacccaggaggcagaggttgcggtgagccaatgattgcaccactgcantccagcctgggtggtagagcgagactcagtctcaacnttnatcaagatagganngaaatagaanggaagaaagagaaaaaataaaaatana

SEQ ID NO: 872 - DNA, 3629 bp, Homo sapiens
ccacgcgtccgccagaggctgggaaggaaaaattattcccatcttaaaatatcttaaaaatatgtacagatttattgtaaatcaaaattttcctcataactacagccccttcccacacataaaattccccctaaatcaggaacataatgtacagcctgtttttaacttgtatttttccattcacactatgtcacaaaaaaattctcatggtgatccatgatttcacaggtcctgtccatgtgtttcctgagaagacagtcctggaatggaattactaattcaaaaggcatttttaaggctgttacacatactgccaaatcggccttcaggaggatgacacaaattccacctatgtcatctgagcgtgccactatctgctgctattgccccatgtttgaggttttgtcctttctcctcattctcatgggcaactgtcaacatcaccaccactgtgatcctgaaaagaaaggctcagaagacatagacagtctgggatttttttttttccctacctttctttgcactgtagggaaggagtgagatgtggctgcaggattggggaatagctaagtcagaaatgagcagcagtgcaactgtggcaatcttggaggggggtctcagccatgaaagaaaacagggggtgccttgccagctggaggctgcagaatcttagcttgggtgttttgccttctccgtggaactgacagatgacaggaatgacgtggagtattctcatcaagcgtctcagcatagtcagtctctgagatggcaaactttaggcaaagacacctgggctgaaaggtcccacatttaaaacttgtcagtcagataactgcccaccaccaccctctgtaagatacctagatatgggaaccccacactcttccccaataagactcttgtatgactgaaagactttgtggttaaaaacatatcttaatctaacctgtattttccctgctgcaatttcagccttttcctatcttttcatggtgaatgaacaccacacaggctttcagatcagacaacttctggctccgtcatttactagctgtatcagttaacaccagctgctgacttcacttctgcatatgcattccaaaattagtgtcttaaaataacaactacttattacttttcacaagcctaaaagttggctgaatggttctgctgatctgacttggttaatcttggctggacactgtctgattcagcataggttgactgtcctctgcctcatgtctcttatcatccataaattgcccaggcttgcttgcctgaaggcagaagagttcccactagcaggagagggcaagcacttttcaatgcacaagcacctttcaagcctctatttgcatcaagtttgctaatgtcccgctgaccaaagcaaatcatgtggcttacttcggagtcagtgtgggtaggcattacccaaagaaagtggctatagggaagcatgaagatctagagccattagtacaatcaatctaccacattaactttgtgaccttgggcaattcccttagcctctctgagctttaactctataatctataaaagtgcagaatttttttgggattctttgctataatgtatgtaaaatgtctgctacacaataaacatgccatatttattaattttcttttctcctccttttcatcatttgaattttttcttaaatgcatatatatatgtgcatatatatatgtccatctcgatatatatatatgtatatatatatatatatatgacttactctgtcatccaggtgagagtgcagtggcatgatcacagctcactgcggcctcgacctcccaggctcgagtgatcgtcccacctcagcctcccaggtagctggaactacagatgtgtgccaccacacccagctaaatttttttgtatattttatagagaagggtttcattatgttgctgaggctggtctttaactcctgggttcaagcaatccacccaccttgacctcgcaaagtattgggattacaggcatgagccaccatgcctggcccttaaatgcatcattcttatacattcctttatacatacaaagctcgaagataataataataaacattattcccacggcttctgttgaatccccaactcctagcctgtgcctaatcaagtgtgccctcaattcattccaatggtctggaatttgaagactaaaggaatcaaagggtatctcttccctttgttcctgggaccatcaagttgtgaaatgacctcttggctttctgatctgggtccactaccacaaatgaaatagaaaggagttaacacatttgcattaactgatgattcttaatagaggcaataaaatgagaaacccccatttcctaatttaaatgtggctttggggataggataagtatcctggccgctccttagctaatcaggctccagaagggacattaattgcagccagcgcatcctgctggggagacccaaggctgccagctcccttgctgagaatggaatagaattttaattggctgtgaaagcatcatggtaggaggtacagggaagagttggtctgctcccccaaagcaggttagggaagctccaagggaaaggactcaaacaggtgcatggcagcaagaacctcccatgctcaggggccttcccagctgcaacaccacagttccaattccagggctggactccagcctaggtgaaggaccttctcacacttgggcgattagtactggagcacggagcctgtgaatcttctcatctctgtgcttcccccaacttccatgagagaagcaccacatagttactgtcacttgtattgtcaatcttcgacttcagagaggtctccaaatataagctcaactccccagtgtactgtgtgtgtgccattagtccatgtgtatggtctgaagcaatggcacagcattcctgtactgttgtttcagagcaatgtgaatttatttcactcacaataaattaatctaactatgcttagggcaaagttgttctcatggtaatgagtatgtcctttctgccatggcaatttctggaacacacatatagacaagaatgacatgtgaaggtcaatagatgagactatgaaaaacaagacaatatagctttttagcataaatgtacaatgatgcatgtggtttttggagattgttggacaaattacttaacctcttggtgccttagttttctaattattaaaatgagggcaacagtattgctgatctaataaggcttttggaaagaataatgagatgtaaagagcttagaatagtgcagagtcttaataaacatgtcttcgtgattccttctagtgaagtgacatagagaagtgggaccagtcattgacccacccaagctctgtcaacctagtggtatagtaaatctgttggcaaaaagcaaagcagaacaacaaaaaaacgcaagcaaaatcattgctttcaggaaactattttgtgagacagaagcttgataaaaattcaaaatttgcagtaaactctacttcattaatactttaaaactcacagcaataaaccattacttagaacaagtaagcagttttgtttttattgtgcattttgatatttattttcaaaaaaaaaaaaaaaaaaaaaaaaaaaaaaa

SEQ ID NO: 873 - DNA, 4062 bp, Homo sapiens
aattcccgggtcgacccacgcgtccgcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttcccaaaaaaaaaaaaaaaaaaaaaaaa

SEQ ID NO: 874 - DNA, 2274 bp, Homo sapiens
cggtggaggaggaggcagagaggagtggagggcggagtagacggaggaggctgctgcagagaagaaagtgtcagagccggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaaaaaaaaaaaaaaaaaaaaaaaaaaaaaaaaaaaaaaaaaaaaaaaaaagggcggccgc

SEQ ID NO: 875 - DNA, 1064 bp, Homo sapiens
  misc_feature (462)..(462): n equals a,t,g, or c
  misc_feature (1047)..(1048): n equals a,t,g, or c
  misc_feature (1050)..(1050): n equals a,t,g, or c
cttcagcctgggcaacagagcaagaacctgtctcagtcaatcaataaatgtatgtatatatatatatgtatatatgtcagaccaccgtctgaaattgctgttcatgattggaaatcgaactggaaacccgaaggcaggagatgtgtgctcccttgggatgtatggggaaatcacacagagctgttagtacttcagtcatgggatttgctctcatgctatgcatatgggcctcacaacttgtaaatgccactggaagatggcttatctaaggttccttattttgtggtctttcccccttagttctgcagtgagtggggcaaagcgtgtcactgaccttttgaatggaaaacactggaagccttagcgttcttaattcctgaaatgttcatttttwcttctaagcaactgggcttcasaggagattagggcaggcaataacagtgttgacaccagggcaactgntttcycctgttatgggattatwcaacatctgctttctgctaagctccatggaaggcacagaggaaacacagcagagtccatgccttagagactttgtacctgatgaattgagtggtatcaggacaatgctatttaatgtttgatccatcccttctctaagcacatctcagatttctgtgctacctgatttaaccctttcagttcatagaacccagaaggataaggtgaaaagatagaccgggaaaagtaatgcaagtggccaagagtagcttccacttcaaagttcctcatgtgtgtgtgctaacattgtgacttctgttcagtcattgtcagtataaactgtacattggaatcatttgtagctttttaaaaaatgcctatgcctcaccctagacctaccacatcaaaatctcaggatagagtctcaagctaaaaagcctctatttgagccaggcttattggcacctgcctgtagtcccgtactcagaaggctgaagtgagaggatcgcttgaactcaggagtttaacgccagcagaggcaatagggcaaaatagcgagatctcatctctttaaaaaaaaaaaanntnaaaagggcggccgc

SEQ ID NO: 876 - DNA, 3864 bp, Homo sapiens
acccacgcgtccgtttctgaagcaatgttaatcctactagccaagcatatcacttagtccccactgtgagatgagggatatgtgcttaaattgtgaaacaaatatatgagtcaggtatttttcctttgagtccaagtggtttatgactttctttcctgtgttctttgtatatgtgggagttttataattttttatcaagaatgaaaggttggcctgtgttcttactggtgcaggctgtcacatttctctctgttgcccagtcaggtgctatggcatgtgctgcttctggcgtagtgtactctgtggatgtaccagcatgttcttcaaggtcatgactgattttccagacctttggaattgagataaatgttaaatttgtagctatctctgaatttcttccagatacttttcttcatttgtttgtttgtagggtaaacatacctgatagcagcaatttaagcatacccttagaatgaccatgtatggccagtgcacctgaatgtgtgttccaaggtagggaatccaggaatggccaactcggagattcattccttactatgataaatatctgagccccctgctcatcctgtggaacatgggcttattggggattaaggccctgagttttaggttaaatgaaggttaccagatggaggtcattagggggagggtgttaaatgaaaatgctttataaactgcatgctgtttgcaagcagttgcagttttcctgcccagcccgcagccactggccatgcagtcatgttgtccagcctgccgccactggaccatttctgtacataaggcagttctcctgtccgcctgccaccagttctccactctctccccatatgtaagcccctagtaaaccccatgtctcatttgctgcctctgggtcttttcttcagcctcttgaacctagtgccttccctgctgaggttaataggggtacagcacaacagtgttgtaacacagaaagtgatatttacagggatatctctctcacaatatctcttaggaaaggtaaataaaatgttcacaacttgtaggtgagtaattccttagataagttgtttcttaacttgggaggagtttgggaaggaacctaagcaggctgcagaggctgggcatgggagcttgtcatggctggaagttgaaatggtcaactccaggcagatctcctggggcaaagcagcctccaccaccagtagcccttcctttctgtctttcataccccactgctccatctgaagcctgaaccccttccagaaaattgatggatagattttttttttcggctatatatagttttagaggttagaactagatataattcagtctagaagatttctccttccccagaaatgattgtttttgtgcaaagccccgccaaaatagtacggagacttagactgagttcactcatcactaacaattaactttataaacattcaacaagtaggacaactattattactgttactcagaacccttcgctctgtatatacagtttgatttaagatgccacatttacatggcattttcaaccttcaaactctagcagattttaaaactaggtggatgaaaatagaatcattctaataaatgtagtgtgtcagatttgaaaaatcatttggtgagcaggatctctgtaaagttatatgggccacgtatacaagacgtaactgaagaaaattaattcaacagagcatgccgtacttgaacgacatagagatttactcgaactgaactaactcaagctgcagaactccgagcaagcctggattgtaaaagtctgggtgaaaatagatggagtatgccctgactgaacctctgtactgccccacatgcttatacaggtgggggattggatggctgttaggtgatcattgcattctcttttggatccctattgagaagaaatgataagagagggaaaggatatggggcaagaacagtctgaaaaagaaaggataaagttctcagactctcttcacactctaagaagaactttctgaaaagcttggattaggtctggcaatggatataataagcaaaggactcttggaatgtgttcttggctcttagccccacctctgactttgagcaaatcagctgatttctctgcctgtaaaataatagtccctctgatattaatacttacctcatgaggttatttagaggatagtgttggtaataatgccttgtgtttacatcattcctttcacagagagctcaaagcactttacatgcattgagagagaagcttctcgtgaagagtaaatagaagtgttcactttttggaaatgaacttaggccataagagcctgaatttaatgcattgcaggaagaaatatggtacatagtgaaccagtgggtcaactgaattttttgttccactaagagtcccctcctggctccttgttttgtgaattgaggaatatggtgagtccctacacctggatgggaaatcccacatatgcaattggaatggtctctcacgacacatgcagagattgaagaacagtctggacattttttgataacgttctttgggccttggtagtagctgaaagacacctgagaaatcttagctcagagctacagaatgacactaatggatcccagaaatagaaatgtagatgtggagtgttttatctgtttatttcacctcaattcaaccaatactccttgagtgccttttatatacatgattttgagtgatgtggagaattaaaagagccccacatgctcaggaaagttaaccctggttttagcaaggaaaagaagtaggatttccaaatagataagtgcaccgggtatgtggaagttcagaaaagcttcccagtatttcagcccatctacttggccattctcaaccatgtattactcatgtaccaagcagtatgctgttcacagagagatccaatctctgccttagggatccttggggaaaacatgtacaaagagatagttttagcacattctagtaaaggcagtgatcaagggcacctagccttacgtggcaatttagggaaggtaccttggaggatgagacttctcctaaagtcttaagaattgaaaagaacatgggaagggaattccaggctgggagagtagtatgttcatacgccctcagtgtttaaccttctttgaacaaaaaaatggccaactacagaaagtttggtcttattgtagcctaaattgtacttaggggtacgagtgagaaacagggattaagataaaggacctgttttgctgtcttgtttactgttgaatagtagtatgaagtaggtcctgaaaaactatgtttttggggaaaaaaaaaaaaagactgaatgatatgttgggtttaagtccttgcaggcaggctatccaggtaaataaacatggaaggtgatgggaggtaatctgggctggaaatacagatttggaagtcaccccatatcagtggtgtttaaaatcaagagcaaatgaaattgcacaaggagaatatatagaatgaacaaattaccatgggtgaagccttgagtaatacagacatttaagaagcaaacaaaagacaaggaacccatgagggagactggaaaggaaaaaacagagaaataagaaaaaatgagaggagagaattgatacattttcctcaggtgtggcattatggagttcactggtgtctcatcagagaagtttcagtccagtggccagggcagaatgacattgtgtcttgttttaaagtaaatgggtagggtaagaaagttgagaagggttagcacaaacctctctttcaagtcacttgccttagaagagaaggaagggtatggtttctggggtgcaacccaggttcaagaagcaaaaaaaaaaaaaaaa

SEQ ID NO: 877 - DNA, 2084 bp, Homo sapiens
aatggttacactgaagcctggtgcctctcttttaatcaacatcttggcaagagtcttctggtccctgttgacgtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgaccaactgagtgccatattgaattccattcagtcacgacccaatcttccagctccttccatctttgatcaagctgcaaaacctccctcttccctagtacacagcccatttgtgttcggacagcccctttccttccagcagcctcagcttcagaaatctccatctcgcaaccttgcttctcgtgagcgcatttacaaaaattatggtgtagctgggcctgcctctgctctctcatctctgtctcacaaactgaagggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccggagcctttagagccagccaaagcaagccatgtctccttctgtggccgaatgtgccagagctgtgtttgcttccttcctctggcatgaaggcatagtcatgatgcatggcttgtcttctttcctaaagtttcatcctgaactttccaaagaacatgctcctataaggagtagtttaaatagccaacaacctacagaggaaaaagaaaccaagttggaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaaaaaaaaaaaa

SEQ ID NO: 878 - DNA, 1029 bp, Homo sapiens
cccacgcgtccggaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacaggtacatatacttctatatagctgtaaatagatgatatggtttgtgtccccacccaaatctcatattgtagctcccataattcgtgggagggcgggtctttcccatgctgttctcatggtagtgaataagtctcacgagatctgatggttttataaaggggagttcccctgcacatgctcttgcctgctgccatgtaagacatgcctttctcctcctctgccttgtgccatgattgtgtggaatccccagccatgtgcaactatgagtccattaaatgcctttttctttataaattaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 879 - DNA, 411 bp, Homo sapiens
ggttctagatcgcgagcgaccgcccttttttttttttttttttccagtttttyttttcaaattcttgtttttatttttaagcctgacttgctgacacacagcttagtgatcaggcaatgattggttacaggttgtgtttgcatctcttgagcctactaggcttccaacctctgcccatgggtctgtgcagggttagggagcaaaagttcaagcagttttcaggtctatcccacttttcctttcggatcagccctgtcacatttccttcatacgttcatgcagattcccagccaaccagggacaaatgggtaccatgggatctctctagttttacctgcatgtgtgcagaggcttctaagtcagccagaaatgtgtggacagcccttcagacccctctgtaactgtctcatt

SEQ ID NO: 880 - DNA, 1387 bp, Homo sapiens
  misc_feature (1380)..(1380): n equals a,t,g, or c
cctgcaggtaccggtccggaattcccgggtcgacccacgcgtccgcggacgcgtggggtgtgagacgtgcctttcaccttccagcatgattgtgaggcctccccagccacgtggaactacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccacactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcamcaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattaaaaaaaaaaaaaaaaaangaaaaaa

SEQ ID NO: 881 - DNA, 1212 bp, Homo sapiens
tgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttatttgtcttgtgatagaaattcaactttgtaccatcttaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatactttaagaaaaaaaaaa

SEQ ID NO: 882 - DNA, 1424 bp, Homo sapiens
actgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcatga

SEQ ID NO: 883 - DNA, 1585 bp, Homo sapiens
ggaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgtkcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgtwctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaataggactgttttgcaataattrgaataaagatttatttcttctaatcaaagatgcataacagctattatctaggggaccmccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaagtcatttgtaacccatgcagaccattgtttgatctatgctaacttatcaacttggctattcaataaagttaattgaaaagaaaaaaaaaaaaaaaaaaaaaaaaactcga

SEQ ID NO: 884 - DNA, 300 bp, Homo sapiens
  misc_feature (268)..(268): n equals a,t,g, or c
  misc_feature (284)..(284): n equals a,t,g, or c
tgaattttttgccaaacttagtaactctgttaaatatttggaggatttaaagaacatcccagtttgaattcatttcaaactttttaaatttttttgtactatgtttggttttattttccttctgttaatcttttgtattcrcttatgctctcgtacattgagtacttttattccaaaactagtgggttttctctactggaaattttcaataaacctgtcattattgcttactttgattaaaaaaaaaaaaaaaaaaaaaaaaaccccnaggggggggccgggtncccaatcccccccaaa

SEQ ID NO: 885 - DNA, 2130 bp, Homo sapiens
  misc_feature (2045)..(2045): n equals a,t,g, or c
  misc_feature (2107)..(2107): n equals a,t,g, or c
  misc_feature (2117)..(2117): n equals a,t,g, or c
tcgacccacgcgtccggactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacargctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaacywcggcctgcaggagacctggtactgggactctgggaatataacagaggtggwgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcaytcagcactggtgcargagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgaagggccacaaactagttctgtctcgaagacctgaatgtcaggaggatgtctccaagccggtatgantgtgccacttttggaaaacaaaggcttcctgtgggttgctgggaactctaccggcttgaacntgaatggtcngtggaattgaact

SEQ ID NO: 886 - DNA, 995 bp, Homo sapiens
  misc_feature (960)..(960): n equals a,t,g, or c
gggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgwckatgaagccatgttttttgctcccacagtgctrggcttggcccgcctaaggcactgggtgtacctgctttgcttctctgcagttttcygtagggagctaagtgaatacaccgaagtcttacctctgaacccctcacagcctagggacaggagcggccggcttacctggtgggttgggggacgtcggcagctcgcgtactacgccagcaggattgaggagcagagaaacagttgcagttggttgtattcagtacctgcatttccgttgggaactccacctgtacttgttattctgtggaacttttttttatttgtagaaggagcaagaatattgaccttactatatagcacacgaaacaatctatgctgtatygtgcctgctcaatccttaaagttaacttctaatgatagtaaaagaccttcctgctgcctttaaaatgcagcttgtgctagtaacatgcatgtgtcaaattgaagaattagacatagatgactagatagaaagtaattttgtaggtaattttagagttcaactccacccagctttcagtgaaggaacctttcaaataatagatttttgcttaccatagagaaaagatcaaatgacaaagcaaatattgaccattaagctggaatatggtgataattgaacagttgtataaatgaagtaattgaattgtacacatacaatgggtgaattttatggcatgtcaaagtatacctcaataaagctatttttttaaattgcccaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaa

SEQ ID NO: 887 - DNA, 1459 bp, Homo sapiens
ccacgcgtccggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttaaaaaaaaaaaaaaaaaaaaaaaaaaaaaaaaaaaaaaaa

SEQ ID NO: 888 - DNA, 835 bp, Homo sapiens
  misc_feature (20)..(20): n equals a,t,g, or c
  misc_feature (827)..(828): n equals a,t,g, or c
  misc_feature (832)..(833): n equals a,t,g, or c
tgaccactagggctttttgnaaaaagctatttaaggtacccctatagaaggtmcgcctscaggtacsggtccggaatttcccgggkcgaccacgsgtccgttctcaccctccgccccctcattcacacttgtgattgattattattattaccatcctaatgcatgtgaagtggtatctcattatgttcttgatttgcatctctctagagagtaatgtcaatggctaccttttcatgtgtttgttgtttggatatcttctttggagaaatgtctatccaaatcttttgcccattttaaattttaattcttgccttttagatcttgagttgcaagaattctttgtatattctaaataccagacctttaacaaatacatgatttgcaaatgctttttttcccatgctgtatgttatagttttactttcttgatagtattttttgaagcacaaacattttaaattttgatacagtttaatagatctattttttctttgtttacttatgcttttgtgtcatatttaaaaaactattattgtctcatacaaggtcataaagatttacacctaggtttattctaagagtttaatagttttactttttacatctagtctttaatctattttgagtaaatttttgtatacggtgtgaagtagaaatctagcttcattatattgcattgtggatatccatttgtgtggtaccatttgttttaaagactattctttcccccattgaattgttttggcaccctcatcaagaatcggttaaacataaatatatgcacttctttctgaactctcagttcaatcccattgatctatagtacnnctannac

SEQ ID NO: 889 - DNA, 1797 bp, Homo sapiens
ggaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaagagacttaaatggtaaatttttaaaattttcttatctcttactttttagttttcaaagtagaaaaaatcaggaatttttttattaactagtacttacatattaaataaaatttattattggctaaaaaaaaaaaaaaaaaaaaaaaaaaaaaaaaaaaaaaaactagttctagatcgcgggcggccgc

SEQ ID NO: 890 - DNA, 1107 bp, Homo sapiens
  misc_feature (1101)..(1101): n equals a,t,g, or c
ccacgcgtccgaaactatccataatatgatgttttgttttgttttgtttttgagatggagtctcgctctgttgccaggctggcttgcagtggcgagatctcggctcactgcaatctcctgcttcctgggtttaagcgattcccctgccttggcttcccgagtagctgggactacaggcgcccaccaccacgcccggctagttttttgtattttagtagagacggtttcaccatgttggccaggatggtctcgatctcctgactttgtgatctgcctgcctcagactccctaagtgctgggattacaggcatgagccaccccacccggtccatatagtacaatcttaacccaaaaagtgtgtgtgtttgtgtgtgtgtgtgtgtgtgtgttttgtttttgacagagacatgtaggagacaggtggaaaatttgaggctgatgaaccaaagagaatttcgagtttttagtactatatgtggttgatacttgaagccatggaaattgccaaatttatcaaagaaaagggattgtgtggccaacagaatgttagagaaatttcaagagttgagggcaaagagaaaaatctagagaagaaattacctgtaatgtagaagaaaaagtacagttcactgaagccatgtttcatgcaggatgaagtctaatcctatgcagggatcactgaaaggtgactattgagaaaaagttattattggctgtgaggaagtttcaatagcatagtggaatagtaaagcaggtcacagggaacgaggagagaatctcctctgaggaagtgaagatgagcagtagctggataggataccctggttgaggttgttttttaagttacagacaactgagtagttttgtagaggaggcatcctgtgaaagagaacagagttgaaggtgaaaaaacccaggaggaaggaggaggagattgaaatgagaacatgagtaaaatgggaactagagaaaaaggaatagttaatgagtgaagatagatggagagatgttgagggaattcactttgacttgtgagtaaatcatattagaggggaaaaaggttcagatccaaactgggaacgacaggaaagtaaaaaaaanaaaaaa

SEQ ID NO: 891 - DNA, 604 bp, Homo sapiens
ggcctcccaaagtgctgggattacaggcgtgagcaagattatatttctttaataaagaatacgtgacttttatttaagttgtcagatttattggaaatgttgttcgtaatatcttttgatgtctgtggtacctgtaatgattccttttttactactactgttttttttctctctctcttccacccaccatccccatttactttatttttccatctttatattttcaggctctttattggtcagaattcttagttgtagaaaagagagttcacaccaggtactcttaagcagaaaatgttttattaaggggcacagacagcacagacagcttacaaaagtgtaggggacccaaacagaaaccctttaattttactgattagaatggggagctcaacagaggcaactattaaaatgtgcagaaggtattcagaagattgtgagcaggcatatatgagagatttcattacaagctctctacagtaaccaaccataatgcagaatagaaattcattattttggacttttgctacctgtcaatttaactgttacgtttttacggacttgttaaaaaagtgattagatagactgttttagattttcctta

SEQ ID NO: 892 - DNA, 2187 bp, Homo sapiens
gaattcccgggtcgacccacgcgtccgccaaagtacagggattataggcgtaagccaccacgcctagccccaatactaattttttaaagcatgatttgatgtcccagctgtagccatgcaattttgcatggtagtagttcataaaaagaaaaggaagttgtggctttgataggatgcttccaaggtcgtgtttttaatacttttggtaaattctgttacttgtgtctgttcaaaaggacagaggttgggagatgcatatgtggattctgtctcttcattttatcttcactccccgtttggtactttgtgaagtcaggccaaataaaatagttgaagatactatcatataactctcaatattatggcaaaaagagaatgagaggaaaatatttagctatttcttttttaggatttttactaattgtgttattaaaaaggagcaaatagagcaggaactgaaacagacttaaagtcagaggactggactgcacacattagcatcttgcagaccttagctgctcatgatttataaatgcttcagaaattatcaaagcatgaggcacaggctgtgtttcagccttccccattttcaccaagcacttctgcaacacctaaacactgaccttttcaagcaggcatgaataaaactctcctctgggcagaaggtgcgtgatgactcatggcaaccagaaaggggatgtgtaactcgggatgtggagtctctgggcttctagacccagacctccctgtcttctggcccactgttctttctgttgtgctacagcaatacctgaaggacctgcgtgttgaacaaataaggccaggaataagttgtcaataggagcacatgacatcttgtctttaaaatactaatttcctgagacgtcgttctacagctgctcagcacagattgggtatttatcatctatatgttcaacttacattttattttcattttattcttgatatgcagacatacttttctccaatgtataattatatttcatagcaaactttgcactacgtccataaggagatgtaacctgcatacaaatacacacagcagcagtctctgtatgaataaatccttacctttatgtgataagccatgctaatgataagaagcagtgacatggatcaacatgaaatataatttttttaaaaaacctttgaggatagacatttttccagcatatttatctctgataatgtgttctttaggccggtactaattttggattttattccttgaacacaaaccagttaatatacacagagaatattctgagtgcatgctaggtatccaaggactgccagtttgtaagaaattttacaatggataactcccataaatgatcaaatgttgactgaacagggaacgcatgatattgtgaataaatcatattcttcagaataccttgagttttggcctacctcccacgctgacctccctccaactcttcttgaggtctaactggactctcagtccagccctgcactggagatgcctctcagtccagccctgcactggagatgcctctccatgggaaaggggtgtttttggcccagtttgcctgccacttaagctccttggtgggcagggtggagacagggctctgcaccctgctgggctgagtgtgctcattcagaggaagcatttctgaactctgcaattgccagcagccctggcagcttctctttattcctcagaaaggaaatacaaagagttacctttagttctgagttggaaaaagaggctgttgtggaacatttcattgagggactgcacagtttccttagagacttatgtgatgatttttctccaagtcacccaaaagggtgttcttccatttgaacacctgtcctcttccatggaggacagagactcaaagacatataacgtcttcaagtataatgtaatataataccatgttatcaatcagttaatcaacaaatattgatcaaagagttatcatttgcgaaagccccgtgaagcttacaaaaagaagacagacataaaccctacctttacggaagttaccacattccacttggggagatgacacctattgtaggataaggaataaaatggttagtaacataaggaaaatgaattttaaaaccataggcattcacatgcaaaaacaaaacaaccaaaaaaaaaaaaaaaagggcggccgctctaga

SEQ ID NO: 893 - DNA, 2144 bp, Homo sapiens
tcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccctgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcagctagcctcctgcattgtatggttataaatagcaccctagtgagtgctgtcgtccagtctctcttgggtgtggtttgaatgatctcgggatgcatgactaaaatggaattacgatggcagatcggaaacgcgtttataaacaagtgatggtttgtgagtcgactgtcaagaccaggaggtggtgcaccgtgggaggttgccttccctcccatcacttctt

SEQ ID NO: 894 - DNA, 4541 bp, Homo sapiens
ccacgcgtccggagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtaagaagagtctctcttttgttttcaccatgaatccatgaagtatgtgatggttttgttttgacttgttttgttctgctttgctttgtttcacccatttttttatgcttgttgacattctcgagcccaaattttttatagtttcgatgaattctataggttggttttaagatgtgaaactaaaaggtgatgaaattattcacattgtcatggaatgtacttcctggtttataaactatgaaagacaaaatggcagggccttattgaagaagagtacatctttgaacaaatatttccttcttctgcttttctgtttacaatactctaagtttccctgaggtttggcgtgagctaagactaaatttacattctcttctggagtatgtatatggactcgcttttgggaatgattgtttgccattgtgatggaggtttctttggtttgttgttgttattttggttccataataattagtaatatttttctgaatgtattctgattgaattatttaatttgaaaaacatgcattgattttataaagtaacaaagaattcagttcaatgatgtatactcttgccaaaagaatgataaatacaaagtggagatttttagctttgataaaaagtatagagacatattacttataaaataacttaggtattctgagataggcatgttatcttatacaataaccagtttttaaaagataaacttgctattctagcatatatttgtttgttatagtattaccacaatttgaggagtaaaattactgtatgatttagtaaaacatctttatctgtgatgtatttaattaacagaatttgctaaaagagcacaatgcatccacaaaatacttaactttttaatcttaattgtcctccaagtcttatcccatactatagacttgaagaagcgtaaattataatctttgtttatacacaaagaagcgcctcactctttcattctattatctaaaagattctgaaaaaggaatttgtattatattccttccttggtagtatcatatcttttatccacgttgagaatcagaatttttccccttcagtgttattgtaactcctatgtaatcataattctgtgtttatgcttatcacaaaatattttaaaaggtagaataatttttgtgaatcaagtttatagtctgggggaaggagacattttaccaatgtgaaggttaagtctcagtcattttctagtttgcttttttgaaatttggagtgtggtgaatgaccatagatgcactgcgttaagtgtaggtataaaatattctgtagcactgatcgaatacacatgagttcctccatagtgtctaatcatccattgcttcaaacattcatatgatttctgtgggctgggatgagtgtctttccaccagtgaaaactctgtgtatttaagacatataaataattgctcataataattcttgaatcttaaaccttgaattcttaaatcttaatgttgtcatttgtttcctatggaacattttcattggaaggagggtttttaatattttcatgcattgaatcttaatggtagtattgttgagagctcagttgtttttgctgattattattcttatatttttctaatttttaagttgaaaatcctgagcagtggccagtttgccagatgaaactttaaattgaaatgctaaattatggtaacagtgtttttaaggacttgaacatccagttattcatatttatctattttatttaagaaatgctttggccacaactttttttgcctctttctgttattggttctgtttatataaagcaagatttcataacataaactttgttgttatgttaacaaaaactttacccattctttttctttttatgtgttcagaactgatgaggacttgactttgacctgattttaatcctatattcatgcccataccccattttaaatgccgcactgtgaggattggattgcaaggcaatggattaactcgctaaaatataaagcactcagtcaatcacttggtttagatagtagcagagagcagacagtattgatattatcaaagtatgatttcccagtgttaaatatttgttctggctctactgtaccctagaatataacatttagttgtctcctctcctttatttctcttaaacacattatacactgataacaagccaaaggctgtccttgataggcctcctctcaacgtgacaaaacataaactctgtgaaacattgtttaggtagactttaagacattggttctcgaacagaggtattctggtcacttttttccaaaaatatgtgttgggtattgtgaaaatgtatttaaataaattaattcataaaaaagaaattatcagaacatttgtttcagcatactttgcatgagtgccgcaccacagcaagatcaacagctcatcggacagaactgcaacaataaagactgtagacttttgagattgatgttgtgaatagtttgtctaacagtaaaaaggtaagccaaggtttcttgggtgtgggatccaagactatggctgtctaatttgcacttgagtgattaagtaggaaatgagatatgatcccacatccgaggaaatcctgagctgtgttttcactggggtattttggtgtgaaagaaatagatttgggggtccaatggacaaactgggtaattacaagatcattgatttgaggcgactggttggaacaatcaggatgtctggaacaggtagtgcaatctgtgttgatttgaacttgccatgtggaggtggtggggaatcttacaagttttgttttttgctctttgattttagtgatgaatagagatgtgataatgttttaattagaaaattcgtacagctatctagctgccaatttttcagtttaaagatctcatgttaaaaaaaatttgtttattacaaagtaggaatagaatagaagaaaaaaatacctctaccattcctcagaagaagctagtaacaggtcagaattagttcttctaccgacaccctttagtggtttcctttccagtggtaacacagaatatcactcttactgtgtggtgtatgattttcccccaccctggaaatgctattggaagtgataggaaaaactgccaataagattgacaaagagggaagggaatgcaggactctgcctactaacctcactccccagtttcatgttagagctcctggcgacctcctgccatttagtttcacacttcttatacactaaatatttaacttttctttcacttttgactttacacattctttgtcctcagccagttttgacataaactttccatatttgctttcttcagcatctattatttgatatattgttacatagtccttatatatgtttaaaattattgttagtagggtattttttaaacattctattgtatggtttataatcatcttagaaatgtagggagaaatggccaggtgtgatggctcacacctgtaatcccagcaccttgggaggccaaggtgggtggatggcctgaggccaggagttcaagaccagcctggccaacatggtgaaaccctgtctctagtaaaaatgcaaaaatcagcttggcgtggtggtgggtgcctgtaatcacagctactcgggagcctgaggcaggagaagcatcacttgaacctgggaggcagaggttgcagtgagctgagattgcgccattacactctagcctgggtgacaagagtgaactccgtctcaaaaaaaaaaaaaaaaaaaaa

SEQ ID NO: 895 - DNA, 1002 bp, Homo sapiens
ccgaaataatttcaatgctctcaggtactttgctttcttttcctattgtggcctgtgcatctatcctttacctggcccagacctggtgccaagagtggaatcatttagactttagtgcatcagcaaatatcccttcactcatataccatcctatgatgaaaaaaataattgcttgtattttaaagttaaaaacttcagttcttccacaaattccagaaacataagaaatatgtggttcactgtttaacaaagccatttctcatgagtactgatgttcctttgattagttagagggaccttctctcagaagaagctctcaagtctagaagctcaataagtgggatgtgagaagttttaatctttgaaggaagccactgttacgttggaactggtgtaatggctcctgagagctaaatgtatatgtgttttcccaactcagtgtccagaaatgtcagactgatagcttgaaattttccttggtgggagtattttcacctagaaaattgaaaacccctgaaaatccgaacttttttcctcctggagagccaattgttaaatatttaccagcataccactgacggtagctagccttccttcacctgggacttgatgaagttgatggatttactaaactattctgcatatgatatgcataacaatctcttaatttgggtttgaatataattatacactctgtattaatttcttttccccttccccacatatatgggttaaaaattcacttaatttgacatgtaaatgtatgcaaagtagcaaacaattcatgtattttcgctgagaagcctggaacattaataacactgcaatcttaattacgcagctaccaaaccaatgctcattcgaaaccaccctcctatattgcacctatggaaaataccctgctgaaatgaacttttcttctatgattgacaaatccaatagttcacagctgaaaaaaaaaaaaaaaaaaaaaaaaaaaaaaaaaaaaaaaaaaaaaaaaaa

SEQ ID NO: 896 - DNA, 2657 bp, Homo sapiens
  misc_feature (179)..(179): n equals a,t,g, or c
aatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatnggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaamaaaaaaaaaaaaaaaaaagggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggktgtggtggttacscgcagcgtgaccgttacacttgccagtggccctagcggcccgct

SEQ ID NO: 897 - DNA, 723 bp, Homo sapiens
cactcattaggcaccccaggctttacactttatgcttccggctcgtatgttgtgtggaattgtgagcggataacaatttcacacaggaacagctatgaccatgattacgccaagctctaatacgactcactatagggaaagctggtacgcctgcaggtaccggtccggaattcccgggtcgacccacgcgtccgcaggaaagcagttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggcaaaaaaaaaaaaaaaaaaaaaaaaaaaaaaaaaaaaaaaaaaaaaaaaaaaaaa

SEQ ID NO: 898 - DNA, 2609 bp, Homo sapiens
gcgtccgggccaaaatgctgagaacgtccactcctaatctgtgtggtggtctgcattgccgggccccctggctctcttctggcattctctgcctctgcctcatattcttgttaggccaggtgggcttgctgcagggacacccccagtgcctggattacgggccccctttccagccccctctgcaccttgagttttgctctgactatgagtccttcggctgctgtgatcagcacaaggaccgccgcatcgctgcccggtactgggacatcatggaatattttgatctgaagagacatgagctgtgtggagattacattaaagacatcctttgccaggagtgctcgccctacgcagcccactctacgacgccgaaaacacccagacgcctctccggaatctcccgggcctctgctctgattactgctctgccttccattctaactgtcactcagccatttccctgctgaccaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaacccttcctggacctcaagaacatcgtgttgaccaccccatggatcggggatgagagaggcttcttggggttggcttttcaccccaaattccgccacaatcgcaagttctatatttattattcgtgcctggacaagaagaaggtagaaaagatccgaattagtgagatgaaggtttctcgggctgatcctaacaaagctgacctgaaatcagagagggtcatcttggagattgaagaaccagcctcaaaccataatggcggacaacttctttttggcctggatggctatatgtacatattcactggggacgggggacaggctggagatccctttggcctgtttggaaatgctcagaacaaaagttccctgctgggaaaagttttaaggatcgatgtgaacagggcaggctcacatggcaagcggtaccgagtcccctcggacaatccatttgtttctgagccaggggcccaccccgccatctatgcctatgggatcaggaacatgtggcgttgtgctgtggaccgaggggaccccatcacgcgccagggccgaggccggatattctgtggggacgtgggccagaacaggtttgaagaggttgacctcattttgaaaggtggaaactatggctggagagcaaaggaagggtttgcatgttatgacaaaaaactttgtcacaatgcctctttggatgatgttctgccaatctatgcttatggccatgcagtggggaagtcagtcactggaggttatgtctatcgtggttgtgaatccccaaatctcaatggcctgtatatctttggagacttcatgagtggtcgacttatggctttgcaggaagatagaaaaaacaagaaatggaagaagcaggatctttgcctgggcagcaccacgtcctgtgccttcccagggctgatcagcacccatagcaagttcatcatctcctttgctgaagatgaagcaggggagctgtatttcctggcgacctcttacccaagtgcctatgcaccacgtggatctatttacaagtttgttgacccctcaaggcgagcacccccaggcaagtgcaaatacaagccagtgcccgtgagaaccaagagtaagcggatcccgttcagaccactcgccaagacagtcttggacttgctaaaggaacaatcagagaaagctgctagaaaatcttccagtgcaaccttagcttctggcccagcccagggtttgtctgagaaaggctcctccaagaagctggcttctcctacaagcagcaagaatacattgcgagggcctggtacaaagaagaaagccagagtggggccccacgtccgccagggcaagaggaggaagagcctgaaaagccacagtggcaggatgaggccatcagcagagcagaagcgagctggcagaagtctcccttgacctattggtcaaggtggccgacagggtgacgtgagagaggagagccacctcatcaaatgaaagtcactgctgaataaagaccttagaagtctgggaagccagggtagaggtggggcagggcggttttcctctccctgggaaatcttgctgtctactgaataaataaatgcaccttctctgtatgcagtgcttctgtgggagaccatatcccagattgctggtgcacctgggttatggtaagcactatccatgagcctgcttggaatcacactggatgtctccgttttgtcttgtaaatgcctacaacctgaggtaataaatcaacatttgctcaaactggcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 899 - DNA, 465 bp, Homo sapiens
ccacgcgtccgccccgcgctgctggtcccggggtccctgaaccgcgggcggccccgctccctctgctggccatggcccccccgcccgcgtgccggtccccgatgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcaaaaaaaaaaaaaaaaaaaaaaaaaaaaaaaaaaaaaaaaaaaaaaaaaaaaaaaaaaaaaaaaaaaaa

SEQ ID NO: 900 - DNA, 791 bp, Homo sapiens
acgcgtccgaaagaactgttggggcagatctgtttgttcatgtatttgaaagcatataaatgtgggcagcaagaaggtgtgagttgcaatagacagtaattgaaatatctattattggcacctgctatttgccaatggtacactattcatggtgtgcattattttgtcactttgctcagggaacttgtctacaaaattcattccaaagtgggctggttaaaggttgccaagggtcaacaggagggaaccagggttctttccaggcagctaaaatgagcccagtctgctactctggccacaccggctggctgtcacggccctgggcaaaaagcatctctcaaagtgcagatgacagaagtcctcctagcaggaggacttagccaaggtcaccaagtatttaggatggaatgaggattaaatccaagttggctgactcttccttcaatgctttctgctgtgccatgactccctcctgctttacaaaatgaataaggaggccaggcaccgtggctcacggctgtaatctgcatacactgggaggctgagatgagcagatctcatctcaaacttgaggtcaggagtttgagaccagcctgggcaacatggagcaaccccatctctacaaaacatgtaaaaattagccggtcatggtggtgtgtgcctacagtcccaactactcgggaggctgcggtggcaggatggcttgagcccgggagactgcgctactgcactccagcctgggtgacagagtgagaccctgtctgaaaaaaaaaaaaaaaaaaaaaaaaaaa

SEQ ID NO: 901 - DNA, 2265 bp, Homo sapiens
  misc_feature (300)..(300): n equals a,t,g, or c
  misc_feature (2162)..(2162): n equals a,t,g, or c
  misc_feature (2258)..(2258): n equals a,t,g, or c
  misc_feature (2265)..(2265): n equals a,t,g, or c
aaatttctcaacaccacagtcakctwagtcacctactgccaccttcgaaaaacacggagagcacctacccagaggagaaggtagatttggagtaagccgccgtcgacataattcctctgatggtttttttaacaatggtcccctacgaactgcaggagattcttggcaccagscctccctgttccgccatgattctgtggactctggtgtctctaagggagcatatgctggaatcacagggaacccatctggttggcatagctcttcccgaggtcatgatggcatgagccaacgtakggnaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcayacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttgganaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggnccccccn

SEQ ID NO: 902 - DNA, 2061 bp, Homo sapiens
  misc_feature (1703)..(1703): n equals a,t,g, or c
  misc_feature (1796)..(1796): n equals a,t,g, or c
ggttttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctarcaagatgagatttgccctcgttcctaaacttgtgaaggaagaagtgttctggaggaactacttttaccgcgtctccctgattaagcagtcagcccagctcacggccctggctgcccaacagcaggccgcagggaagggaggagaagagcaatggcagagagcaagatttgccgctggagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaatacatnagttggattttaatgatataagcatcacacaattttacattaagaaatactgtgcagcccatgcgtggtggctcaggcctgtaatcccagcantttgggaggccgaggtgggcagatcaccggaggtcaggagttcgagaccagccttgccaacatagtgaaaccctgtctttactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaaaaaaaatgacctcga

SEQ ID NO: 903 - DNA, 2247 bp, Homo sapiens
cagggacacagcagcgtccggcgagatgaaggcgcttggggctgtcctgcttgccctcttgctgtgcgggcggccagggagagggcagacacagcaggaggaagaggaagaggacgaggaccacgggccagatgactacgacgaggaagatgaggatgaggtggaagaggaggagaccaacaggctccctggtggcaggagcagagtgctgctgcggtgctacacctgcaagtccctgcccagggacgagcgctgcaacctgacgcagaactgctcacatggccagacctgcacaaccctcattgcccacgggaacaccgagtcaggcctcctgaccacccactccacgtggtgcacagacagctgccagcccatcaccaagacggtggaggggacccaggtgaccatgacctgctgccagtccagcctgtgcaatgtcccaccctggcaaagctcccgagtccaggacccaacaggcaagggggcaggcggcccccggggcagctccgaaactgtgggcgcagccctcctgctcaacctccttgccggccttggagcaatgggggccaggagaccctgacccacggcccctccccacccccacccggctcacccccggccctgccagcactctgtctggtaccttcccctcctgcccctgcaccagctttggagaatggatttggagtgtcttgggcgatccagccagcgcaggcccccggcccggttgcttcctcagttcccggctgtgtccttggtgtcctttctccaccacctgtgagcagcaagactgccgcacgtgggcgctgggtccagacctcggctgccacgtcccaggacctgcagccctcacgggggctggggatccccatcagcacagccaggcagagatgatacccaccacacacctgggggcccccacacccagtcctcacccttaacttctgccatgggaatttctccatctgcagcagtcacacgggcccaccctgcccttccccaggtcggcctctccgctgtctggagggaaggggatttggagggaggctgtcgtcgcccccaggaaagacgggcctgggggaggcgggacagtgggagaggcgcgctgaggatgagagggcacagggaggtgggttggggtgaggccacatgcggaggggcggggcggggcggggctggggggacaggcaccaagtatgaagaggatggggccagcggggcctgtctggctgtggcgtgagcaccgctatgggagaccctggcttggaaagtgaacttgcagccttggatggggaagggccagatgctgggtgggtgcctgtcaccttgaggtgaccatctagggtcagtacctgctgggcttaggacagcgcctgaggctgggaatacctgtctctgctctagcagaggctaaagcaggctagagcagtggaggggtggagttgatgaaaggagaggagtagatgagatggaatttttccagcctcatcctggcctgccctctagactccagtccccaagccctcagcctagtgggtgtcatggatggatctgggggtgtcagacaggctaccctgtgccagggagggggcagaatgggcctgcagcttcctgcagaggaagcaggactgggtagcagagccgggaaggtgggtggcccattacaggggggtccccagggtgtcctctggcagggctgtgactgctgcaagctctgccttcaccagtagctggtgccaggacagagctctgggacagcaggcagaggccgagcctgggccacagctcagccactgacttgggtatcagtttccccttctgagaagtacagagtgagacttaaagaacccctagatccccaccagttcaacactccattaactgggaagcccagagtcctgtccggcctgccaagttcatcctggtggacagcgggaggcctccgctaactgttctcttcttttccttattaataaaacacacaatgcctagctggggggtcggaaggcaaatgccctagatggtggggtcacgtctttctccttctccttcctccttctgctggctgaagtgatgactggagctcagcaaccactttgcaccatgaggcagcactgagcacggtagggcagcctggtgagaggggcctagctcgctgccgacagaagtcactgcctacctcagggtccccttacctgggtgggaaataaatttctgctgtgttgaaaaaaaaaaaaaaaaaaaaaa

SEQ ID NO: 904 - DNA, 1580 bp, Homo sapiens
  misc_feature (1567)..(1567): n equals a,t,g, or c
  misc_feature (1575)..(1575): n equals a,t,g, or c
ccccgccccccgcccacgaaggaagtggctgctgctccggcgcggacccagagccggttcggcgcgtcgactgcccagagtccgcggccgggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaatgaccctcgcgatctagaactagncggacgcntgggt

SEQ ID NO: 905 - DNA, 2018 bp, Homo sapiens
  misc_feature (2010)..(2010): n equals a,t,g, or c
  misc_feature (2012)..(2012): n equals a,t,g, or c
  misc_feature (2014)..(2014): n equals a,t,g, or c
  misc_feature (2016)..(2016): n equals a,t,g, or c
cagcaatgaaatcctgctttcttttcctcagaactactatattcagtggctaaatggctccctgattcatggtttgtggaatcttgcttcccttttttccaacctttgyttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcacttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctcgagggggggcccggtacccaattcgcccaagntnancnag

SEQ ID NO: 906 - DNA, 2505 bp, Homo sapiens
ggcacgagattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccacagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaacaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcgctctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggggtttccccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccaaaaaaaaaaaaaaaa

SEQ ID NO: 907 - DNA, 1225 bp, Homo sapiens
  misc_feature (452)..(452): n equals a,t,g, or c
  misc_feature (1135)..(1135): n equals a,t,g, or c
  misc_feature (1180)..(1180): n equals a,t,g, or c
  misc_feature (1212)..(1212): n equals a,t,g, or c
tcggcacgagtcggacatgcgcgctcsgagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaargcattctgaantacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagagraacgtratgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgggcaagnacctggatcactgacagaaagtcggattaaatgcaaagagcttgncaagaagatggcatctacagaaatcgattggntatccaactggca

SEQ ID NO: 908 - DNA, 1108 bp, Homo sapiens
  misc_feature (1)..(1): n equals a,t,g, or c
nctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaactctttttaaataaaaaatac

SEQ ID NO: 909 - DNA, 1692 bp, Homo sapiens
tgcagtcctagctactggggaggtggaggctgcagtgagccgagatcacaccactgcactacagcctgggcgacagagagagactctcccaaaacaaacaaacaaaacccaaaaataaagaagtcatcttgaaagaagtttcaacatttgccttttcattctgagattacagttttctataaacatctaagagtgaagagtctgacgttttttggtcacagctgagccactgcgtgacccccgccccgccccacactcactttgctctaggcaaagctgtactctgaaagctggccccaatggggaggttaggactgtgcctgctcagaagtctgtgggtgcctcagagaagggcaacaaccctaggctggaccctagccttgagagtacttcctactgccagagcccscagatyycttccggtggcagcagatactgccagaagagcctgcggtgcacacaccagaatccgggtacttggatgagaaggacacattactgatcaccttcctccaggcaaccctgtcagttaaggactacagtcccgcccccattatgtagatagggaaacagaggcaaagaagttaggaaactcgcccagaactctcagctcatgaataaaaaagcagaactaaaacccagtgctctccctggctgggcaaacgtgtggaagttgatgtgcctggttactgtttgtgcttcgcttatcataaccagtgacagcgtggttagcactgttcgcctcaagggcagctgtgaggattacttgggattgtcctgtggaaacacttcacatgcatattaactaggagaaaagccactggagaatgagctttatgagctctatcaatcaccacagctagtctgacctaggggtaagcaaaatggaagacaggaaaaagggaatacatttgctyaggacagcgtgagggccacgtgagctgcttgattggtagcgatttgtacaggggctttatggatcactaggttttaatttgcaaggcctgaaactgtccttagcattctctgaaacccacagtgccagtcgcccttcacgcctcggccagcagaaagctcctcatgagtggatcctcttgagaacttcagaggggtcaggtgacggtgactgagactgcctcagtgatcacgctcggtgctatgagctgaaatctgggccaagggcacagtaagttcaggcagctagtatgtttaaaataactacttttcgggagctaagccatgaggacgtaaaggcattaagaatgatacaatggactttggggactcaggggaaagggttggggtgagggataaaagggtccagtgtacactgcttgggtgatgggtgccccaaaatcctggaaatcaccgctaaagaacctcacgtaaccaaacaccacctgaaccccaaaaacctactgaaacttttaaaaattaaaaatacatacataaaatagctacttttactgctgtcaacagcatgttcctgaaaaatgttggaattcaaactttctggagggcagctggtcaagaaacttattcacgtcaggagttttctaaaatttgtttttaatgcttattggtacttctgcattagaagtaactacaaatgtcttattaaagtttccactttaaatgcaaaaaaaaaaaaaaaaaatgaccctcgagggggggcccggtacccaattcgcc

SEQ ID NO: 910 - DNA, 986 bp, Homo sapiens
tggtcttcagcctgtagcatagacaacaaagtgtcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacacccctcaccacctccaccaccaccaccacccccaccgccaccatccccgccacgctcgctgaggctgctgtcgccggtgcctgtggacagcagctgcccctgccctcccatctgttcccaggacaagtggaccccatgtttccatgtggaaggatgcatctctggggtgaacgaggggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcaggcctctggcgggcagggcactgggagaggccctgagaatgtccttttggtttggagaaggcagtgtgaggctgcacagtcaattcatcggtgccttagtccaagaaaataaaaaccactaagaaaaaaaaaaaaaaaaaa

SEQ ID NO: 911 - DNA, 1520 bp, Homo sapiens
  misc_feature (71)..(71): n equals a,t,g, or c
  misc_feature (473)..(473): n equals a,t,g, or c
gcttttttcttaagtgcacaaagcatcatactccctggaggcaaacacatcgggctgcttcagcgttacgngatgcttagcattttgaatattgtggcaaaaaaattaaaagttcacttattaatatttatcagcagtatcataatttccatcctcttatttcagaatttcacttgaggcaaaaataccacaagtgtaattactctagcacagctattaatgtgctggatgataggccactgcgtcacatgaccttctattgttcatgggtttaaagagaaagcagggctttgtatttctttttcttcttttaaagtcgactgtagcatcttggcttttgtctggggtggggaggatctggggtctggttcactttgtaaaagtaaaccatgtctgtttaaacaatagaggtgtttaagaagactctttagttttcctgcagattgttcaagattacatgataatcacacggngtatttatttcctactgacaaaccaagtacttgttacatcaccaatggtaccaggagatgaagacgcgggttttgagcaggagcgagattaccacccaaaaagggagctacctgaggcagcccagcttctagcaaactttttacatgttgcacatttcagttcttaaatgaaggctactccagtgtcatttcattaaagtacctgggtgtagtactcaagtcccccctcaagagttcataagtaagcagtatccttttggccagtggtcctgtttttgcccctacccagactgttcgrgaagcatattctatagataaatctgacatttgtcatccaataccattgcagtcctctgcagcatacattctcaatgggggctgtatcacccctagattggttctgagatactgcaatgtcttgtgtccttccaaaggaccataatacttgagcaaatatgaacatttcttggggtgagggcagaaagagagaaacaaaagtctaaaaagggacaataatgaaaaaacagttgagacctttagtatgatgggaacaggatgaggaaggaggagatactgacaggagccctgggtcttgctctgcattaaacagatatttatggacattaaacagatatttatggagcacgactctgtaccctacaggcccagaatagtcttaaggctcctgggaattgatgataggccatttacccagtttcagtttagaggcagattcactggccttagcatttcagtaattatatttatttatttttagcctgaaccagatttaataggagaaactactttctgcgtttcttttaattacttgtagtttacacagtaactttagaagagtaaatgaaagcatgcttcgatgctgccactgtaaataccattcattagtaacttattttccctggagtcttgtgaagtgtgaatttaaagcctgctctatctggaatatggaatagtattaagattacaagcacattttatattcatgagccggaaaggcaaaaaaaaaaaaaaaaaatgaccctcgag

SEQ ID NO: 912 - DNA, 856 bp, Homo sapiens
gaattattgaaaataactgaaagaaagcctagtggattgttactaatgatttaatgtattttcttttaacctgtaggttctctcttcatctcttgccttgccctctttttctttgttttcttcctccttgcagtttatttgttgaagaaaccagttatctctgttttgtttcccatggtatgaattttgctgagtgcatctttacatgtagtttaatgtgttgtttggtccttcacatttcctgtaaattgacagttgaatctacaagcttgatcacattcacattttttttagggtggtggggctggcggtacacacagttatttccatttcatgatgttagcagtcgttgataatcatgctgcgatctattcattatatgttacaaaatggtgatataattttatcatttattaactgttcctttaaaagtttatatcatatatctctgtgtgtatatataaagattaatgtgcaggagttttgctttcagtgaatgtttgcattccaatcattgcttagaaagtttttttgcccttgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagtcgagatccgtctcaaaaaaaaaaaaaaaaaaaaaaaaaatgaccctcgta

SEQ ID NO: 913 - DNA, 540 bp, Homo sapiens
gtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaa

SEQ ID NO: 914 - DNA, 2060 bp, Homo sapiens
ctcacaagagagcagaggagccccaagtcttggggaccacagaagatgccatgtgctccacgatgtcggcccccacctgcctggcccacttgcctccctgcttcctgctgctggcactggtccttgtcccctcagatgcctctgggcagagcagcaggaatgactggcaggtgctacagcccgagggccccatgctggtggcagaaggagctggggaccctgaaccagacctgtggatcatccagccccaggaattggtgttggggaccactggagacactgtctttctgaactgcacagtgcttggagacggtccccctggacccatcaggtggttccagggagctggtctgagccgggaggccatttacaactttggaggcatctcccaccccaaggcgacagcggtgcaggcctccaacaatgacttcagcattcttctgcaaaacgtctccagtgaggatgcaggcacctattactgtgtaaagtttcagaggaaacccaacaggcaatacctgtctggacagggcaccagcctgaaagtgaaagcaaaatctacctcttccaaagaggcagaattcaccagtgaacctgcaactgagatgtctccaacaggcctcctggttgtgttcgcacctgtggtcctggggctgaaggcaattaccttggctgcactcctactggccctggctacctctcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtctctcctcaacacccttgcccctgctgcagccctttctggtgcgccctgcccctttccccacctcgctacatccttcttggcctccaacatccaactcagagtcttcttcccaggagatgtctgtaagaatctctgaactcaaccagccagaccatctgtgcccctccatctacacctttctccccactccttcctgccttccttccatccccctcatggctggcttgggcaggtataatattagaatgcaggttcagcaactataacaaagctcttaaataacagtggcttaaaccagtggaaatcaaccagaaagttgaccatcagcaggccaagcaatacagagactccctggtattgagacccaggattcactgatctcattgctaccaggtccaccttctaggcagccagactggaaaagagggcaggaaaggggagcaggaccctcccctttaagtgcacagtcaggaacttggccacctcacttatctctacttggctggaatgtggtcacatggtcacacctagctgcaagaaacactgggagatgtagtctttatttctggcagcaatgcgcccagctgcaagttttcactagagaaaccagatggcagatatcaggggataaccagttatctccaccacagcagcatacagacagcctctcacctgccctgtgggacacctgagttcaatgcccagctagctagccagcacttcttcccactatcacctcccctggggcagcatgatgtggggcagtagttcccaagatgagtgattttgcccccactggacttttggcaatgtctagagatgtttttggttggcacaacctggggggtgctaccaccatctagtggactgagaagccctgacatggggaagagtgtgcatgcccaggagtcagacacacctgcctttaaccctgaggcctctgcctcctccctgtgcaccctcagtgactaatcagagtcccttcccatcacggaacatccaggatactaatgtggacttctctgcattg

SEQ ID NO: 915 - DNA, 776 bp, Homo sapiens
aaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatactaaaaaaaaaaaaaaaaaaaaaaaaaaaaaaa

SEQ ID NO: 916 - DNA, 1297 bp, Homo sapiens
gactcgtgccgaattcggcacgagggsaaggggcgtcttctgtccttgtggtccgcttctaggctttttggagcatcttccagggtcactccagagacccccccagactactgaatctgaatccgttaggtggtccaaccttcctcttcaggtgtctactagaggcaaggttggatgtatgcggctgccctcagtacagccccttccttgttttttcttcatttgtgtttacttaaaacattaatccttttctccctctcctccatccctctccctcccctactatacagttatgacttacactaatcattcccgatgatctcccagaaggaaataagtgtctgtctgtctctgtctctgtaccatcgtcttcttggtacagttcggactattttttctctacaccccagttatgcaaagtgtagtccctgaaccagcagcctcagcatcctgagggaatttgttaaaaacgcgaaatctcaagccctacccagamttactgaatcagtgtctgcattgcaacaagatcccctggtaattcmtatgcacatcaaaatttggaaggcacagctctcaactgatgtcctgggtctccttcacatccatcctgggaaggtcttattcctcattcctgagctcatcccactgaagagctatggcacttccaattcctgagcctttgtgaggttctgcgtgtcagtaagcttgcttccgggcatcacctccgaaaacacttgggtttcagttttctctgtgaggcttcttaaggagtggaggaaagtggatgttttcaagataacgcagctaacattcaaagaggttaagtgaattgtccaaagtcacacagcaagcactggagaggcagtgtctcaccatgttgcccggactggcctcggacttstgggctcgggccatcctcccgtctcggccttccaagtgctgagatcgcaggcgtgagccaccacgtcccaccgggatacataggttttacggtatcctctgaacctccctttaatcaagagagtggacaaaactgtgggtcccycmtyttcaaaatggccagtaaaagaggaaataaggatatgcaagtttagttattttctgctgccctctttaagttgattggggatctctttgtcactactttgggaagataacttaccttcttatccactatggctaattggagcttttctcatgtctttatggttgctgggaaattttcaaataaaattcactgggaatggtttgaaattgcaaaaaaaaaaaaaaaaaaaaaaaaaaaatgaccctcgta

SEQ ID NO: 917 - DNA, 4386 bp, Homo sapiens
  misc_feature (3477)..(3477): n equals a,t,g, or c
gacctcgataacagttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtcggtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcagnccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaaaaaaaaaaaaaaaaaaaatgaccctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccacgattaaagaatgttatcg

SEQ ID NO: 918 - DNA, 4386 bp, Homo sapiens; identical to SEQ ID NO: 917
  misc_feature (3477)..(3477): n equals a,t,g, or c

SEQ ID NO: 919 - DNA, 1944 bp, Homo sapiens
ggcacgagtcatgtctgtgaaagtgaaactgaagaggaagaagagacaaaaaaccccaaacagaaaattgcccagacaaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcgtgttagccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaaaaaaaaaaaaaaaaaaaaaaaaaaaaaaaaaaaaaaaaaaaaaaaaaaaaaaaaaaaaaaaaaa

SEQ ID NO: 920 - DNA, 794 bp, Homo sapiens
gcagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggargagarctggtcctggggggctcggacccggcacactacatcccaccctcacctttcgtgccagtcaggtccccgcctatggcagatccacagggagc

SEQ ID NO: 921 - DNA, 741 bp, Homo sapiens
gtagacttctggaccttgratgtcactgagtttaagagaaaggtagtcccaggactctggtctagcagctgagtaaggctcaggccttagaatggcttagcttgctccattgcaatgcatcatcctggatgttaaaatccagctgtctctctgaaamctaaatatgaaagactgagatttagtcaactttgctgagatttaatttacatataataaaatgaatcattttaactgtgcagttcagtaagttttgaaaaatgtctatacagattcatgtaactgccaccaaaattgagaaaggacacttccaccatctcaaaagattctgtgtgttcctttgtagtaagtctcttctaccccatccctagacaacagctgatgtgctgtcattgtacacatatattagctttgcctgtcctagaacttcatgttaatgggaagcatcctgtatgtactgttttgtgtctggcttcttcagtgtatttttgaaatttatccacattgttgtgtgtatccaaagtgtgttctttttcattgccaaataatgttctgctatatgaatatattacaaaatatttgtctgtttatctattggtggatttttgcattcgttccagtttggggctattatgaataaagcttctgtgaaaattcaaaaaaaaaaaaaaaaaaaatgaccctcgagggggggcccggwacccaaaacggagtatttccctttttccccccccccgccccccg

SEQ ID NO: 922 - DNA, 1071 bp, Homo sapiens
  misc_feature (158)..(158): n equals a,t,g, or c
gccgcgcaccagttccctgaggtacggttctccatggtgcacaagcggatcaacctggcggaggacgtgctggmctgggagcacgagcgcttcgccatccgccgactgcccgccttcacgctgtcccacctggagagccaccgtgacggccagcgcanagcatcatggacgtgcggtcccgggtggattctaagaccctgacccgtaacacgaggatcattgcagaggccctgactcgagtcatctacaacctgacagagaaggggacacccccagacatgccggtgttcacagagcagatgatccagcaggagcagctggactcggtgatggactggctcaccaaccagccgcgggccggcagctggtggacaaggacagcaccttcctcagcacgctggagcaccamctgagcmgctacctgaaggacgtgaagcagcaccacgtcaaggctgacaagcgggacccagagtttgtcttctacgaccagctgaagcaagtgatgaatgcgtacagagtcaagccagccgtctttgacctgctcctggccgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggacccccaaaaaaaaaaaaaaaaaaaaaaaaaaaaaaaaaaaaaaaaaaaaaaaaaaaaaaaaaaaaaactcgaa

SEQ ID NO: 923 - DNA, 714 bp, Homo sapiens
ggcacgagcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcctggcccccgaatgacccccagatttgactccaacaacgtggtcctcattgaggacaacgggaaccctgtggggacacgaattaagacacccatccccaccagcctgcgcaagcgggaaggcgagtattccaaggtgctggccattgctcagaactttgtgtgagttgagcccaggcctctggttgcaggactcgtgaatggagcagttctgagaaccacccttttgctaagggagcttgggagccacatggctgctcccttcacactgggtaacagtgtagtatcctgtgagagaataaatgtattcatttatgtgtttttccagagctttctgggatgtgggaaaataaattacactgaagcagttgaaaggtgaaaaaaaaaaaaaaaaaaaaaaaataaaaa

SEQ ID NO: 924 - DNA, 1379 bp, Homo sapiens
  misc_feature (639)..(639): n equals a,t,g, or c
  misc_feature (697)..(697): n equals a,t,g, or c
  misc_feature (1347)..(1347): n equals a,t,g, or c
  misc_feature (1361)..(1361): n equals a,t,g, or c
ggcacgagcaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcarctgaattkcgamctycgsaagacaagcctcttcaaccacatggcctccatggggccccgggaggcggtcagtggcctggcaaagagccgggactacctcctgacactgcgggagacgtggaagcagcacasaagacagctgtatggcccggacgccatgcccacccatgcctgctgcctgtcgcccagcctcatccgcagtgaggtggagttcctcaagatggacttcaactggcgcatgaaggaagtgctcgtsagctccatgctgagcgcctactatgtggcctttgtgcctgtytggttcgtgaagaacacacattactatgacaagcgctggtcctgtgnaactcttcctgctggtgtccatcagcacctccgtgatcctcatgcagcacctgctgcntgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccamwacaamgtggctatcccctctgacgtctcccacttccgcttccakttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagcaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaanmaaaaaaaaaaaanaaaaagcggccgaaagct

SEQ ID NO: 925 - DNA, 1564 bp, Homo sapiens
ggcacgagccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatyttcggcctggggcyttaccatcttcatcatgcacatcttcaagcatgctcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggcmaaaaaaaaaaaaaaaaaaaaaaaaaaaaaaaaaaaaaaaaaaaaacaaaaaaaaaaaaaaaaaaaaaaaaaaaaaaggggggggg

SEQ ID NO: 926 - DNA, 874 bp, Homo sapiens
  misc_feature (468)..(468): n equals a,t,g, or c
  misc_feature (501)..(501): n equals a,t,g, or c
  misc_feature (546)..(546): n equals a,t,g, or c
aggggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagncccaggtacctggacactgacaacttgagcccntaccaaggaaacaagggctggtataggtgcaaacctctcatctgnccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttaaaaaaaaaaaaaaaaaaaaactcgta

SEQ ID NO: 927 - DNA, 1645 bp, Homo sapiens
ggcacgagccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccatccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtaaaaaaaaaaaaaaaaaaa

SEQ ID NO: 928 - DNA, 801 bp, Homo sapiens
gaattcggcacgagtggagatgcactgaccttccttgcaagagcctttccctgaagttgggctcctgagagaagttctgaacatggctatccctgccttttcatcttgtcagcagatttcttcagcagctgctctacaaatatgcaatggaccctttaagcatttctcctttacagtgagcacaatgctaagctttgtcagcagatgccactggagcagcattgcagaagaaagcgagtttctcttcctgattttggtgtgctacttttcttcttcttgctccagctgcattatccatcagtggtactatgtataagaccatcccgctgtgccctgccctaccacctgcccagaggcacatccctcactgactatttggcctgattctgagcctgtggccaccttctcacagccctgcaacacaggcactgtgtgctccaggcctcacgtccccagcagtggcctgactgtgcacttagccacagcctcagtttgcctgtgctccaagaaattgcatcctatttgcccagcagctatggaccagctctctggtcctggaaaacagcaggcttctctgacatctagtggactgcaaacacaccttctccaacaaggcctgaccccagccttaaggagagaaccgtctttccgagttgtctttccttgggtactctccctcaatcctcggatacccttgaaagttctctttacattgttatagttattcttctatcactgtcgaataattttttatattaaacttctcttgctttacattaaaaaaaaaaaaaaaaaactcga

SEQ ID NO: 929 - DNA, 645 bp, Homo sapiens
aaggtagaaaagtacagaaaacactaaattttcattgtgctgtttcaatgtggcagattctttaaaatacttcgacacgctacaataattaaaggttttaagaacattaagatacttaaaaaataaaagcccacaattgaataacaaaaatgaactttgttttattttttattggcattaatgtaggttgccgtggtgaaaatagtttgaaatacttcacagtaacagttttgtgcagccctagagattaaaaacagcaaagtaaataagcaggactctcaacgactcatactcacagacatgtttaatgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgtctcaaacaagagaaaaaaataaatcaaatgctattcaaaattctaaaaaaaaaaaaaaaaaaaaaaaaaaaaaaaaaaaaaaaaaaaaaa

SEQ ID NO: 930 - DNA, 1255 bp, Homo sapiens
  misc_feature (1236)..(1237): n equals a,t,g, or c
  misc_feature (1255)..(1255): n equals a,t,g, or c
gaattcggcacgagaactcttggcttccaggttctagcactcattactaccatggacagcagcttccttttaattcagtgggattctgccaggcaggcttccaggggagctgtggggtctagtacaagtttctcccctgttgctgcttcagtggctttcaccctgcccaatacatatttaatatgacaccatgtgtctctttgtcagtctcctcatattgagcctaggaattggcaaacactccatgaatatttacacattgacttttttttaagctcttaagagaggaatatcccttggagtcctctttggagatttccagtgtctcatcatcaagcaatatgtcctttcagctaataagatctttatgtttcataatcattgcttaatatccaaagattaaatttagaccatggaaaggaaaaaagatctcaaagcaactcatgtccctaaaaggaaatcacactcatcaaacaaatacgctgtgttcacacaaagatattactattttctaccttcagtactggcagactttaagtgggatatgaaaagcctcagctgcttttgaatgtgggtactttaccctggtaaacatagattccactcttcagcttggccaatgtttataatactcagccctgcagaaaagcgtcctacttggctctcttatcctccattggcttagacaggaattggggaaatacgcatgtcagtattagcaaaatcagcagcaaagggacagargcatatgaaagtcacctcmcaaaggcaatgcatattaaccctatccttggaraaatatgtgcttccytccagaagaaggaatattcactccagtgtaaamccacttaaattatcttttccattatcttgtttaataatcaaaattcttagaggctgatagggttacacccatttataggcaaagaaatggaaacccagagagataaaatgactttcccaaattctcttagcaaaatggagatagaatcaaaactgaatcccaatctctggtccccattttgttacaatcacagtatttttcacaatattatctcaaactttacccatcgcgatgaggttcctggtctcgcagctctctcacagatgattttaagccagggaaactgctattttttaatgcttattgttttctttgtttaatatgtattcattgtagagatttggggaaaataaaatgaccaaaaatcttaaaaaaaaaaaaaaaaaactcgnnggggggcccgtacccaan

SEQ ID NO: 931 - DNA, 1389 bp, Homo sapiens
ggcacgaggacagcctccaccagagtccccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccccgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtaataaaattccccacactgaaaaaaaaaaaaaaaaaaaaaaa

SEQ ID NO: 932 - DNA, 1142 bp, Homo sapiens
  misc_feature (92)..(92): n equals a,t,g, or c
aattcggcagagctgcctggaagttccagctccgagttccctgggaggactttttcagatgttagggacccgctccagagccccctctggtncaccctgggttcctccagccccaccgagtcactcactgtgggaccctgcctctgaataatcaggaacggtggcttcagagacgtctcttgggccttccctctggccacgtctgcacccacccctsctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgttctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtyttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaaraaaaaaaaaaaaaaaaaaaaaaaaaaaaaaaaaaaaaaaaaaaaaaaaaaaaaaaaaaaaaaaaactc

SEQ ID NO: 933 - DNA, 2622 bp, Homo sapiens
aggttccctcctttggatatttggcagttgtactttatgcagttcagccaagaactaaacacaggccttcaggtgtggtcagagtacagtgggccagaggtcctttcttttcttcatgtggtcatacacctctgttaattcaacttaagtttatattacttttgggggtgggagtggggaagaggatcacattgttgacttgctggaagcattatgtcaactaaaatccttcagttcttattttcatcatgctgttgggttccccctatgttgtttctttttaaaaacaccaaatgcagaacttcccttttatactgcttctatttcatcttgttgacttgtagcctatcagagtatgattctttattgtcatctaaggtattctgatataatcactgcatgtctaaattctagttattgactaaatgctacttgagaccattctcttggttgtcacattattttacagttgaagaaactgaaccttagagaggttaagtaccttgttaaaggccacctggctggaacataacatcctggtcattttaactactaatgctgtcatgaaagggagttagccagggcaggtgtgaatagagcattctagcataagcagccaacaattagagcaactgtgtatttttagtgtgtggatagcaaatctttgctgtcttggaagttactatcttagaagcatggtattaagctctctattcaatgtggtgttcacatcagtagcattggtttcatttgggagctttttagaaatgcagagctcaggccccactccaggcctaaggattcaatctgcattttaagaagtgacccatatacacattaaaggtttaagaagcattgctgtagtatcctattttccacactttagtcatttgcatatcacttgtgcaactttggctttatctgcatacttcctgaagggggcctgcccctccacacctgtgggtatttctcgtcaggtggagatgaaagaatgagaaaagaaataagacacaaagtatagagaaagaacagtgggcccaggggaccggcacactcagcatgcgaggacctgcaccagtgccggtctctgagttccttcagtatttattgatcattatttttactgtcttggcgaggcgagtgtagcagggcaacaggtggcgagaaggtcagcagggaaacgtgagcaaaggaatctgtatcatgaataagttcaaggaaaggtactgtgcctggatgtgcacataggctagatttatgtttcactttacacaaatatctaactagcagagagcaacaaagcagtattgctgccagcatatctcgcctccagccacagggcggttttctcctatctcagaatagaacgaatgggaatggtcgactttacactaagacattccattcccagggacgagcaggagacagaagccttcatcttatctcaactgcaaagaggcctccctctttcactactcctcctcagcacagaccctttacatgtgtcgggctgggggatgtaaggtctttcctttcccacgaggccatatctcaggctgtctcagttgggggaaacctggacaatacccaggcttttctgggcaggggtccctgcggccttccgcagtgcattgtgtctctggttaatcgagaatggagaatggcgatggcttttaccaagcatactgcctgcaaacatattgttaccaaggcacatcctgcacagccctaaatccattaaaccttgattcaatatagcacatgtttctgggggcacagagttggggctaaatttacagattaacagcatctcaaagcagaacaatttttcttagtacagatcaaaatggagtttcttatgtcttccttttctacgtagacacaggaacaatctgatctcttttccccacacttcctatatgttaatgtattttaattgtctgttagcttttatgtctttccaacttgaaataatttcacttacaaaatagctggaaaaatagtaaagataattcctgtattttcttcacccacgtattcccaaatgtgtaacacctacaatcagcaaaaatcagcacattaatattattacctaatctacagacctcattcacattttgccagttgttctgctggtgtgctgtatgtagtgcaggatccagtctaggcccgtatgttgcattttgctgtcatgtcttcttagtctcctttcatctcagtggtcttttcttttccatgactatgacagaaatgatttgtatccttcatatatctgcagtcacatgaagtctatttgtcccactactggtgacgtaaattttggtaacttggttgagggtggtaccgtctaggtttctccatattaagttgctatttttccttgtgtatttaataagtatcttatagggaaatcctttgagactatgtaaatatcatattacatgtattttgcctattttagcatcttttgaagataattgcctgaaacattttttactgtgatgattttctaattctatcattctgcatttattagtttggaattcgattgtaaggaagtatattcccttgtttcctattattttattaaagaaatttacatccaaaaaaaaaaaaaaaaaa

SEQ ID NO: 934 - DNA, 3132 bp, Homo sapiens
ggcacgagtgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatccttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaaacacaagaaaatagagtgaggcttttttaccgtatatacataaaatacttatgaaaattagaagataatttggcattcctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctagatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaaaaaaaaaaaaaaaaaaaaaaa

SEQ ID NO: 935 - DNA, 2601 bp, Homo sapiens
ccacgcgtccgcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagtaaaaaaaaaaaaaaaaaaaaaaaaaaaaaaagg

SEQ ID NO: 936 - DNA, 3024 bp, Homo sapiens
ccacgcgtccggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgagaggactcgggacctgccaggcagggcggctgcggggctgcccctggccccccggcccctcctgggcgccctggtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgctgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctccctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctatgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttcttttaaaaaaaaaaaaaaaaa

SEQ ID NO: 937 - DNA, 2005 bp, Homo sapiens
ccacgcgtccgctgggcctagattataaatgggcacactagacttgaagtcaggagagcttcttttctatggagctactaaaatgctcctggcaattgttcttttcatttttgacccattgcagtgcatccacaattgtatggttgtttgtgcaacatcgtcttagccagtctcataataaaccattctttggaattttacaaagatgtcattcttggcacctaaacagagaatcatttgtgcctaaccaatcattttccatttatgaatcctgttcaattagaaagtagtttatgaacagtgtcctgttttttaaatgtaatttgaaatagcaggtggcagacttgcattttatattacctagatatctcaagcctttatgcttactcattcacacgggtctgctagtgaagccaactgtataaggtgtgggaggtaggcaagcctcgggggaacccagggctcatttggttcattgctgccatctgctggggcttggctgctggcatgggaaggctgcccacgagagagctgagccatcctgaaggaacctctgtatacttccagtactaatcagctattatgtttctaggtgacaacctacccctaactaaaaggactttatgaactctagagcattatatcagtcagtgtaaagtggcattagattatgttggtaacacgtactctacagcaaacatgaggctcagagaacgaagcaacacactaaggactcaaagatcctagagtatcagaactggaagaaccttaagccagatgtggtgggaactttagtatatagttacatgagtcgcctaggcacttgttaaaatgcagattcctgggcctagcccaagagactttgattcagtaggcccaagctgtgtctcatttaacaagctccccacagggttctgatgcaggtggtctagcaccatgctagagaaaagcactaccttaaatatacagacaagagcttctcagccatttttcttattaatgcctcacttcaatcaataagaaaaattacatcttccatcaatgggatgagtcatcatcataccgtaactagttctttgaagcacacgcacacaaattattgttggattgctttgttctgcaacaacaacaaaagagtcgcttttaaataattatcttggctgggtgcagtggctcaggcctgtaatcccagcactttgtgatctgcccgtcagacaggctgctttctgatttctatattattaagaatcatcatcattaatcctaagccaggtatgtagagagtagaatttaagctttatcttagttcagtttctactccaaaaggaaaaataggtatttttaatgtttgaagcttattcccaaatttactactacttaataactgctgtttttattataatgctttccactgacatatattcacttggttccttttttcatcttttcatttttcctataactggaaatttttatttttaaatttttatatttttatattttaaatataaattttttatattttaaaaaaaagacaatttcccaacagagcatattgacagccctctttaagacttctcttttaagaaataattatttgctaacttatgaaatagagccttaattaaaagttttagaatatgaaatgtgatgtaaaataaactattaactatgttgactataagtgggtgaaatttaaacacatttataaaattttaatactttctttttgaatagtgattctaatagaaggaccaatgatctactaccaactttattatggaacagtaacattttcccttttaactttttatatggttttgttttggctctttaaaaaaaaaaaaaaaacaaaaaaaaaaaacagggtctgaacaggtgagtggttcacgtgagtaatcccagcactttgagaggccaaggtgagaggattgcttgagctcaggagttcaagaccagcctggacaacatggtgaaaccccaactctacaaaaaaaaaaaaaaa

SEQ ID NO: 938 - DNA, 1143 bp, Homo sapiens
cccacgcgtccgggcaagtgcaccaccatgactggctagttttgttttttggtttttggtttttggtttttggttttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgcaaaaaaaaaaaaaaaaaaaaaaaaaaaaaaaaaaaaaaaaaaaaaaaaaaaaaaaaaaaaaaaaaaaaaaaaaaa

SEQ ID NO: 939 - DNA, 1458 bp, Homo sapiens
aattcccgggtcgacccacgcgtccgatcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggagacacagccttcatcatcctgcgtaagcggccactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 940 - DNA, 1094 bp, Homo sapiens
ggcagagccccagggtgagaagtttgggagacatgttccattttggtctgtgggatctgcatttcttccttatagttatggctcatagagatgactgctctttcaaaggtggttgtggtctattagagcgtttccaatgtccccatacttctttctcgagtgctagtcaaaagcgacttgcagatggtatggaatgtctttgtgagatagaaagaacacagactaggatcagaaaaatctgcctcccaaccctccatggccatcttctggctgtgtgactttaccgccctaactctttaaaatagccccacacctacctgccaggattgtcttcagaattacataaaataacacataccaaagtctctagaatagagcatgtcacataatagactcaacaaaggtcagcatctcttctttctttttgggatgactaaagtagcctaaataaataagtattccgcaatgcatgacttgataacataaacttttgtaatactctattacctccaagcataaaacaattattgagacaaaagaaatacaatattttctaagttccaagacaaaaaaaaaacttaccaataaagaaaggagctgtctgttccacaaaaccaacagccacagttttttccttcttaaatgtcagactttgaaaaggttgacatttctgttcaccagcatatacacgtgggccctctcttactgatgaccacagagtcctggggaccttcctgtgctcccagcccagctctcctctccggccacactgctgcctccttcacgcatacactgggtggtgtgctgggctgccctccttaccacaagttttattcctcagcacacacttcagatcacagaaaggagacaaataaggtggaggaaggaagatgggttgatgtaactaggtcacttggtaatttcaatttcagacgtaaatttttctgtgtttcagaattattgatctgtggaatatttcttgattcttcttggaaattacaaattaattcaaatgattgtaaagttctctgaaaggctctacagttttcttaagagaataaaaaaacctgaaaataaaaaaaaaaaaaaaaaaa

SEQ ID NO: 941 - DNA, 2462 bp, Homo sapiens
  misc_feature (10)..(10): n equals a,t,g, or c
  misc_feature (2461)..(2461): n equals a,t,g, or c
agctggagcnccaccgcggtggcggccgctctagaactagtggatcccccgggctgcaggaattcggcacgagtaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcatatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactataaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcrcagtggtgatgaccctcatgratgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaacctaatgataaaatataaaaataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaatattaagatacttctgna

SEQ ID NO: 942 - DNA, 856 bp, Homo sapiens
  misc_feature (1)..(1): n equals a,t,g, or c
ncggatgtgggtgagagccccggatgagggtcccggatgtgagtgagggccccggatgtgagtgacggccccggatgaggaactcggaggaggagctgggcccgcgcgtccatgattcgaaggctcgttttcgcagcttttccacgtctttttccggtcccactgccctccatgctaactcactgggcgtctctagccgttataccaacaatgactgcgaccagtgttgggaaagcgccccctgggcccctccctgacgccagcccatccttgagactccctgcaaggaggcggcccgacccagtgggtgcgtgtcgtggggtgaggaggaatggccgacctaatggtcccgcttccgtgagtagcacaggggtgcctgctcagagtgtagtacaacgctgacaagtagaaggcgaggattgcggggcctgggtgagatgggacccactaagttgtgggatcgaaatctcagtaggtccttggggaaagcggggacgggaggggagatgagcagattggaatagaaccgagagagacggaggaaactgacagttgcgtccctggtgggaagactaaaatctatgcagaaacagggataggcaaaagcattgtgcacaagcgggacaggcagagcgccgggacagaaacccttaggacattctgacaccttgctgaacctggatccttacagaatatgtcttgtaggtgaagctagatctgcaaggcataggcaagcctcttagagaatcagaaaagtgatttggaaggaacttcagctgttactactttgtttaagcaaatcaaatgctgttctttaatgttactggacgtttcaaattaaacacaagaaaacctg

SEQ ID NO: 943 - DNA, 1867 bp, Homo sapiens
ccacgcgtccgtcaatgctgtgcctcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattacaggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaaaaaaaaaaaaaa

SEQ ID NO: 944 - DNA, 1923 bp, Homo sapiens
  misc_feature (144)..(144): n equals a,t,g, or c
  misc_feature (1910)..(1910): n equals a,t,g, or c
  misc_feature (1912)..(1912): n equals a,t,g, or c
aattcggcacagccttatgccacagtagtgcctgtagcagagaaaggattccctcctccacctcagggcccactgctgctgctctccagcctgcagtttcctctaaggctctggattggctggaagagcaacagagggctgggnaaagagcttctatatatacctcaggaggaaaggcatcccagacagttttgaagttttcaaagactggctctgctgttaagaagttgtacttaaagcggaggagctaagccacctgccaaaatgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaagccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaangnaaattttttgg

SEQ ID NO: 945 - DNA, 1656 bp, Homo sapiens
  misc_feature (554)..(554): n equals a,t,g, or c
ctttattgttttatatagatgggattatactaattgttatatcctaacaattaatagttatatactgactgtataaatgttatactcacatttatatagatgggaatatactattccttttttgttgttacttatcatggcctcctctcccagcctgttctgtctgcctcggtctctgaagtccgtgtaggattcacagtatcatgggggacagaagtgctataggttgttgaaccctcctgtcttgacgcatatttctagtcatttccagatgcctacataatccagtaaaactccttctgtgtagatcttctgatgtacttgtatatgcagatttttagcaaatattcctaaaattgaattcctagaattgctgggctggtagggtttttaattctgatatcgtgaaatcgatcgctagagaaattttggtacctctctttggatcaaaggcatcagcatttttaaatgaagcttgaactgatttgtgtactggaatccatatcaaactacacaaatttgctaaatccctaacgaaaacagtaatgtttcancaaactgtgagcagacccaaagggcgttgatggtattaattatacatcagcctgagtggaagtcaaaccaagctagttttagaagctatccacaactggtaaaggtaaacctgaatctttttaaaaattgtgataaagtacacgtaacataaaattcaccattttaaccatttttaagtatacagttcagtgacatttaagtccatccacactgctgtgaaactgaaagctggatcttaatttctagtctctaaactgaactgaaatcaattgactttcatttggaaaaagccccacttcactgtggtctgtcactttgatggtgtcagagggtccaggacctcagtgccagggtgcgaggagagcagtgctgtgcagtggggaggaacctcaccatcacccagtctcctcgccagagggtccaggacctcagtaccggggtgcgaggagagcagcgctgtccagcggggaggagtctcaccatcacccagtctcctcaccgtcacccagtctcctcgccagagggtccaggacctcagtgccggggtgcgaggagagcagtgctgtccagcggggaggaacctcaccatcactcagtctcctcaccagcacactttttctccatgtctcgttttgctcctcctctggtatttgtatttcttaaagaggattttgaaaagagatggtgaagttggtattttaggtagaagggaccaattgtttcctcaagactaagttggtccaaccaaactgacagagacgaggtctctacatatgaaagatggaacctggccgggtgcttcgggggctcgcgcctgtaatcccagcactttgggaggccgagacggatggatcacttgaggtcaggagtttgagaccagcctgggcaacatagcgagactccatctctacaaaaaataaacaaaattaggctggtgtggtggcgagtgtctgtagtcctgtctactcaggaggctgaggtggaaggatcacccgagcccaagaggtcagggctgcagtaagccatggtcacgccactgcactccagcctgggccacagaatgagatcccgcctgtctcttacaaaaaaaaaaaaaaaaaa

SEQ ID NO: 946 - DNA, 1559 bp, Homo sapiens
  misc_feature (1547)..(1547): n equals a,t,g, or c
  misc_feature (1549)..(1549): n equals a,t,g, or c
ccggctactaggaactagtggatcccccgggctgccaggtttttattctttatatataaaatgtctcccagataccaaaagatcaaataaaaatcccacccctcctactgcgttcctaggttggctgtatacttatttgaggaatgtttcacagcccttgtttcagtgcagtattttctggtttatggggctggaatcaaagggaccgctattccctctgccccaacacacagacttacgaatcagtgctccctatagcaccatactgcaggattggtgtgcatgactgtggcatccatcagacatattctggtagagatctggttaccgatagccttagccatgggcacccgaggcctcactcaaattgtagctgtcattcaatccagaagccaatgggcactctcttgaagtctgcttggctcttctgttctcttttttagtaggtctgatttattaatatgatcaatacaggttaacttgtgaagtcctatatacaacactcttcctcctctagacaactttgctattgctacttagaaatgatgtaaatcattggaggtgtgataaatttacaaatatttagtttttaacccatagcaagggagatattgggctagagtgtaaaacacagagcatttaatatacataggaaatttaggagtaaaattttgatgctaattttccaaaatcatttctactatttctcgtcattataagattgctcacatattttgaatggcatcccacagtagtcacaggcaaattagaataacatatgctttacaaaacaaaaaggcatatcagaaaatgagtcaaagtaaaaaaaatggcaggtaccatccattctccagtaaataatgaatatggagtgtatttaattacaaatttccaaatatatattcgcataataaagacaaggaaaatgaaacaaaatcaaatgtgttttgttgaaataagcgcatgagcttgaaggatcmagtactgatggctccaggtgttttccatgttagattccctttgaaagtactgatgccatcagcacttgtcagctggtacccaatgatgtaaattttgagcttgaatacttttcatrggarrgcatcacattcctaaaggagacaaatgaccactaaaaactaaccattaatatagattacttatggagggttttatcttgactactaattaagggagtaattgtatctctaaactttatatcagattgccagtggatttgccagattattaatgcttttttagaatacatggggggtggggttataatcacataacacagtttttcatattttttaaaaggggttggaccaagacataagtttcattgacaatcttaatgttttcactgtagacaatatgttagaataactgcagtgagtcacacagcatataacttcttaatggtaaattcagaaccagtcttccagataagcaagtataacattttagttaaaaaaaaaaaaaaaaaaaaaaaaaacaaaaaaaaaaaaaaaaactcgagggggggtcccgtacccaatctcctnanatgcatcgta

SEQ ID NO: 947 - DNA, 1228 bp, Homo sapiens
gaattcggcacgagccattttggtgtgggagtgggaggagctgtgaattatgacagttctaattaatataattttgtctttagtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccactccagaacctagcactccggtgtcgggtaagtgtgcagataccagaccactaacacagctgcattacatkgtctactcagtgttgctgactatatataatgtgtatagttcagtgacattgccaaaagatgtcctgaagaatctcaggtaactggcaataggttggtttttcagtctgtttacttccaggaatggattctttaacaaattatccatgtgagatagaactcattrtgaatgataaagatatttctaaggtaaacctatggttaagaaataatatttaactccaaatacgaaaggatgcttgactaaggcataatttatgtacacagtagcttttgttcctcaagcaatgaagtatacgtgaattctgcacctagccgtaattagctttaaaaagccaattacggctgggtgcagtggctcacacctgtaatcccagcactttgagaagctgaagtgggaagattgcctgaacccaggaattcagtacctatctgtgcaacatagtgagaccctgtctctaaaacaattttttttaattaactgggcatggtagcacatgcctgtgattccagctacttggaaggctgaggtgggtggatcacttgagcccaggaggtcaaggctgcagtgagctgtgatcactccactgcactccagtctgggtgacagagtgagaccgtgtcaccaaaaaaaaaaaaaaaaaactcgta

SEQ ID NO: 948 - DNA, 688 bp, Homo sapiens
ggaaaagaaatttgtatatagcccaaacttaagactgtctcaccagagcttaaaggtgttagctctggccacagcagcggcctcagtcactcttcttacatggattttgatgcaaattctgctccttttctatttctcaagatttctagccccttcgaggggcccaaccctcgaaggagtccagtaaatgtgtaactccactctgccttgcctgtgctgaaaacacatagaaagaggaacagaggaggcaggcacctggaggtcagaatggcagctggattgtgaagaaggtgtggtttgcatgcctggcagtgatgagcttcttaggcttcattcttaacctcggagcaagactcattgtccagccacaagcagcgttggcctccagaggcctccgtgggcagggcctgccctgtgaaactcaggtctgcaagagaaccttgagaccaggtgccgtgggctggctggttcacaaaggaagacgggctctatccatttccaggaagagcgcccttgtctccctgggagtaatgtatgtgggaccaggcaagaggccaggagtggtgaggaaacattcccttcttgtgaaaatgcaagcgaggggaaaggaggtttcccccacaatgtgctagaatattcatccagcctggttgacagagcgagactccgtcccaaaaaaaaaaaaaaa

SEQ ID NO: 949 - DNA, 1337 bp, Homo sapiens
  misc_feature (20)..(20): n equals a,t,g, or c
ctggtgttgggcctgagccncctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccaggggccaccccatcgaaggccttgccgkcatgtactacatcgcacacctgctgaagggcgccctcctcttcatcaccatcgccctgattggctcaggctgggcttcatcaagtacgtcctgtcggataaggagaagaaggtctttgggatcgtgatccccatgcaggtcctggccaacgtggcctacatcatcatcgagtcccgcgaggaaggcgccacgaactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtacmagctcttggtggarggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggaggggtccatgtggaccaggcgcccagctcccgggacsccggttcccggacaagcccatttggaagaagagtcccttcctccccccaaatattgggcagccctgtccttaccccgggaccacccctcccttccagctatgtgtacaataatgaccaatctgtttggctaaaaaaaaaaaaaaaaaaactcga

SEQ ID NO: 950 - DNA, 528 bp, Homo sapiens
  misc_feature (421)..(421): n equals a,t,g, or c
  misc_feature (436)..(436): n equals a,t,g, or c
  misc_feature (459)..(459): n equals a,t,g, or c
cttaaaaaataaatactatctttctctctggcctctccatcctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcaaaaaaaaaraaaraaaaaaactcgagggggggcccgaancccaattcgccctanagtggagtcgtattacaaatcantggccgtcgttttacaacgtcgtggactggggaaaaacctgggcggttaaccccaactttaaatcggcc

SEQ ID NO: 951 - DNA, 908 bp, Homo sapiens
gaattcggcacgagattttattaaaaataagtgcttttctctgcttaccttttactatgatctaactatgatactttcaatatgctgcagactctcattcttatctttcttttgttgttaccttgttacctagaactcttatgtttcagcctaatttcttcatctgcaaagacctaataggaagaaatttttactttggtttagtgtgtataaaatctgggaacagctaaatttcagttttaatataaaattttgacttttatatattacccaatattgttaaaaggagaattctatgtatacctatctcttaaaaatattgctctatatattacccgcttaaaacaacaacagcaacaacaaaaacttagaaggtaaacaaaaagtaatctcataaaacatagaaggggaatacaccttggtttcagatatgcacagaaagtatgtaagctgtaccccagaagcatccttataaattttgcagtcagtttctctgacctttctttacacaggagggatttgttgtaycaatctttaatctaagtgtgatacaccaacttcctattgaattgccttagagcagaagaaaaggtataaagatgatgcatcttacttagaaatgaaaatataacaaaacaagtcatgttaaacaaggaaagatatggatctttaatcacgaacccaaaccaagttggtggctgaacagagaagaactgtgggagccaggccagttggcatgacagtatgtgttcagctggtgtggagtaagcccctggactgagggtgttcagtgtggcttcagccaggggattcagtggtgaagaaccctcttgctactgtactctttgtctttattacaatactagtcaagaaaaaattctttctaaaaagaaaaaaaaaaaactcga

SEQ ID NO: 952 - DNA, 1863 bp, Homo sapiens
  misc_feature (82)..(82): n equals a,t,g, or c
  misc_feature (112)..(112): n equals a,t,g, or c
tgggggttgggatgcagaggcatgaccccctttcttcccctgccccttcctgacatgagatgctctatgatagaggtagctngggcgtggagtgaaacagaatgtgggtttncggggaggaagtgttggggtcacatgctgcttctcctgctttcttacataggtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctyccagcagttcctgcaccgtggtcaccagcccccgcctgagatggctggacacagcctagccagctcccacagaaactccagtacgtaagcctggtggggctgggcagggaggggcaggtggcaggtgagtgtgttgggacaggtatcctccccctccacctctgggagaggacaaggtaggtggagcaatgggttctgttccctgtggtacctgccttagttgacagctatggaccaatccctctctccctttggatcattcactttcccttgtgaagaacatgagccttgtgtcattgtagggatgcttatgcctgcartcataaagtcagtgtgggtttaggcgtgtttgttatacctgatgatgcctccttccccagccccaagcaatatcaaattagccctggacctaggatcytctgtggtgaaactatcaagtatttactaagcacytactatgtactagcactgtcctaagatgatctaaatgatttataggatagatcagtccctatccccaaggagagaattggtactattacatgtaaaattatgtgctacgtatgcagtcacaagaatatttctaaaaaatatatgcaaatatgcaaagcgttacattcagatggagtgctgcccttcaaagctgcccttcaaagcaacctggccgtggtcccaaaggttcccggtcatggtcctttacgaatggtgcaattttattttcaacttttgagttgcgtaattgtagaaaaaccagaaaatatcaaatatttcttttaaagaagaaaaatcaggccaggcacagtggctcatgcctgtaatcccaacacactaggctgagtcaggaggctcacttgagtccaggagtttgagaccagcctgggcaacacagtgagactctgtctttacaaaaaataaaaaaaattagctgggcatggtggcaggtgcctgtagtcccagctacttgggaggctgaggtaggaggatctcttgggcctgtgaggccaaggctgcagtgagccatgatcacaccactgcactccagtctgggagacagagcaaggctctgtctcaaaggaaaaaaaaaaaaaaaaaaactcgag

SEQ ID NO: 953 - DNA, 951 bp, Homo sapiens
ggcacgagcttgaatgtggctcactgatataataaatcacttccctccatgagccaccattcaaatccatctgatgtgcatcttttaatttgaatattcttgaataagtctattgttttgtatgcatttaaatgtacagtattgtactatacatctaattctgcttttactttttatcaccaggcactatgcttatcagtggactttccaagttggaggcctcactgttgcttcaagtgtggtatggcagcacccatctgctgtgtccatctacactttattatatatctatgcacctcatcagggaagcacgggaacccgcaggcactgctagtaggaaggcaagctggcctggccattctggagaagaacatggcagtatactcagtcacattccagtcgcacagcctgtgatttgggtatgcatcatggataaatgttcattgtagtgktatttaggaaatccaggagctggagatggaaagcaatgtgcttgaactaggtaggatgtatacagctcaaatgggccaactgttaaattttcaggaatttggtgagctagtttttataccccgttattatttaaaatcaaattatatamacyyaccactaaataacatatatttttaaaagtaataaatacttaaaacacactgcttcctartgctttcactagactgaaccatcatcttggcttctggggycactgaggcctactgtatctccctggkggacatcccacctcatggkgtgctgctgstgccattctctgctggttctgtgttcagggatgtcctgttggtagcttgaaagaggccatggtgggaataattacactatggaaattagcaaaccctattttggctaaccctgacagctaattgttaaacatttaccagttcactggagactagtattactcccctttacaaatgagaaaaatgtggctca

SEQ ID NO: 954 - DNA, 2432 bp, Homo sapiens
  misc_feature (593)..(593): n equals a,t,g, or c
  misc_feature (2049)..(2049): n equals a,t,g, or c
ggcacgaggcccggaacgctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggastgctggtctccgtcctggaacagggcttgccaccctcccaccgtgtcatctggctgcagagtgtccgaatcctgtcccgggaccgcaactgcctggacccgttcaccagccgccagagcctgcaggcaytagcctgytatgytgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccanagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtaascctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggcggcccgagggcagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagcmantgtkttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaaaaaaaaaaaaaaaaaaaaaaaaa

SEQ ID NO: 955 - DNA, 720 bp, Homo sapiens
ggcaggggaattcggcacgagccctgaaggtttttaatatttkggttcttwaacccagtgggaattackgaatgatttatttaattagggtggggatggagtggatccatttgttkgatgctaaacagcctgagytcgcagttcccagggggcatatctctaaatggtctgaaatgagatttgcagtggttttcttaatgcaattcccaacttctctccaaatgccttttgacatttggcaacatttcatgcctcttcccctttcggttttcatccttgttttctctcccttctcccacgamctcggtagtcttctgcaatccagattctcagacttcaggtttttctccctctgcccctttcctctctgtcctgtaactagaagcaccttttggcatagacccatatcccagtttcctctttcccaggtccagcagcatctcaaggacatctacaagagggatacctaatttcaggggtctctgaattatatgtgggaaacatcgtctaaaaaagtaattttatccttattcatgcaaccagacccacactcatagaacttttctttaaggggagtgtcttgcagatgtataaatgagtgttaacatctttaaaagcgaaactgaacaattctctggcatttgaattccctccttccttcccaaccctctcctttttcattttctcatttattaattaaaaacacttttaaagggattt

SEQ ID NO: 956 - DNA, 2003 bp, Homo sapiens
  misc_feature (1961)..(1961): n equals a,t,g, or c
  misc_feature (1999)..(1999): n equals a,t,g, or c
ggcacgagccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaactcgngggggggcccggtacccaattcgccctatagtgagccnattc

SEQ ID NO: 957 - DNA, 955 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgggaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaaaacaaaaaaaaaaaaaaaaaactcga

SEQ ID NO: 958 - DNA, 891 bp, Homo sapiens
ggcagagctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgtccgcattttgtaaaatggcccctgggggagtgtttttgctggatctgctccctttcgctctctcactccactactttttggaacaaagtgatggcagaatgcggtggtggtgggggtcttttgtactgttggattaataaaatgattttaaaatcccaaaaaaaaaaaaaaaaaaaaaaaaaaaaaaaaaaaaaaaaaaa

SEQ ID NO: 959 - DNA, 451 bp, Homo sapiens
ggctttcgagcggccgcccgggcaggtacatgacaatttttactccatttcttgttctcttacttctagtcaattctcccagattttctacaataactcttatgaggtctggttttcacaacccatcagtctgcttatcttttactctaaaacctcaatgctaccttgttttgatgtatcagaagaacaggagacaagatgggtcaaaagtattttttaaaactgcaagactaaagttctatctcaatataacagcaaagtgacagcacaggcaaattacatataaatactatatgtataaatatgttcagagctcaaaaccactaaccttccatcttttaaggtagggtgcaataacaacagaggttccatggaaatggaaaatagctctatttatacagcaaattcaaatatagtagcttgctaacctcggccgcgaccacgctaagcc

SEQ ID NO: 960 - DNA, 553 bp, Homo sapiens
  misc_feature (11)..(11): n equals a,t,g, or c
ttggcaacccngctcggatccctagtaacggccgccagtgtgctggaattcggctttcgagcggccgcccgggcaggtgtttttgttaaggcaaatgtcttcccttaatatccaaatattgctaataaacggtagaagatgctttggaaattaaaattatctcgctgttggttagacttaacactgttaatcttcagccaaatatcacatatggatcaaattattttcttttttgttgtttaccctatcctcaacaacatttttagtttaaattattgtagagattttttttgtggtggttattttttattttgctccaaaataataaggtgcaaagctattttatgcttaactgttgctctgtcaaaacagctatgcagtggagttgcatttgatgttctagagtttgattacatgcagagttgtatatagccaaaacttctcttatcaaactctgttatgtaggcatatttatatatacattaaagactgttgacctcggccgcgaccacgctaagccgaattctgcagatatccatcacactggcggccg

SEQ ID NO: 961 - DNA, 1004 bp, Homo sapiens
aattcggcacgagcagcattccacttgcaattggaagccgagagaaaccattgtttatgaaakkaaagaggctkctcagatgactgcaaaccagccttccttactggttttatcactggtaatgttataaagacagttgtccagtttcatgaatcttgtaggtttttgtttgtttatttgtttgcttttratgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaamccaaaataatccaaatttgacacaaatacctgggatacatcttatttgagatgtttaacaaatgtctggatcatcttttcttacattggattataacgcaggaaacactgtgaagtaagtaaagttggaattcccaagtcmaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctagatttgaggtaggttttacctaggccctcattatacacttattaacatactaaatcacacacccaccagtgccatgacagttctgagaccaatatgtgatgtaaaaatggatggcaccacagttccgagaaatcacctttacccaggaattttcacgaatattccactccttggttaaagaaacccattgagatgaaaccccagaacccattgttctctctcgggtatgcccgaactcccctttcttgagtgtgtactttctgctttgcaatacatctcttctttcactatttgctgactcatccttgacttggttctcgag

SEQ ID NO: 962 - DNA, 800 bp, Homo sapiens
ccacgcgtccggaaacttgaaatgtggcaaaaaccacatgggcaaaatttctgtctcttttcttatttttgcttttttgtttaaaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggagagactcagcccctcacagcttgggatgttaccttgccttttgtttgttttgagggaagtttaatctttaaactctttggaaataaataattatagctttcaaaaaaaaaaaaaaaaaaaaaaaaaaaaaaaaaaa

SEQ ID NO: 963 - DNA, 939 bp, Homo sapiens
ccacgcgtccgggacgaggggggtgcggagccagccaggccgccctcccgttctcacagcagccgagcagagcgcagagcgggctgccatggctctggccaggcctgggaccccggacccccaggccctggcctctgtcctgctactgctgctctgggcccctgccctttccctcctggctgggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaacggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcagccccacatctgaatcctctttcctatgtttggggaatcccccaccttatgaggcagcgcctacctccagatggtgattcaaaagcaaatgactcaaagaagctgggtcctcagaaaatctattctggcaagtgaaagcagcaagcacagcagcttcatccagtttccagagacagtaattctacctacagtgtctagcaccccctgatggtattggcgattcaacctcgtctgtgcctagaatcttgttcctggatgctaacttctcagcctatttctccagccctccaagagattctgtgagccacctaacaccctgttcataagttcctttcccagactcaatttctgttgctcacaactaaaagtcttgactattaccccatttgataaatgtgaaaaaaagctaataactttgaaaaaaaaaaaaaaaa

SEQ ID NO: 964 - DNA, 931 bp, Homo sapiens
gagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtccscccrckcgtccgcccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcaaaaaaaaaaaaaaaaaaaaaaaaaaaaaaaaaaaaaaaaaaaaaaaaaaaaaaaaaaaaaaaaaaagggcggcc

SEQ ID NO: 965 - DNA, 406 bp, Homo sapiens
tcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaaaaaaaaaaaaaaaaaaa

SEQ ID NO: 966 - DNA, 696 bp, Homo sapiens
  misc_feature (605)..(605): n equals a,t,g, or c
  misc_feature (648)..(648): n equals a,t,g, or c
  misc_feature (655)..(655): n equals a,t,g, or c
ggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttwggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttattggctatgttaaaaaaaaaaaaaaaaaaaagggsggccgctctakaggntccaagcttacgtacgcgtgcatgcgacgtcatagctcttctntaagggncacctaaattcaattcactgggcggccgtttacaacgtcgg

SEQ ID NO: 967 - DNA, 1263 bp, Homo sapiens
  misc_feature (1091)..(1091): n equals a,t,g, or c
ggccgcccttttttttttttttttttttaaaaacaaaacaggttttaatggttaaaacagatgaattaataggtttataataaccattaactaagggaagccctagaacaagaaataaggatttttaattgcatgcaaaacctagttaccataaaaaccaatgcaataccaaaatatctcagcttcctagcatagactccaggtcttttcatttccaatacttggcagtcataatatgtacactttcatatgcacctggttgtggagggataagctcattcacataggactacaaatatctctcacaggtaggagggcacaaaagaacaatatcttcctccacttttttgggtccatcttgaaaaacaaaaaaggcactcccaaaggttccttggtaacacctttgttaggtttcttaattactaacataatctttacatgtaaggttaatggtccactcatttcatagatctgggaaccatcaggcattggaactgcctttaactcacatgccaaacaactggctttcttaaacaatgacaaaaactgtatacttgttttaaaaacatttgggctttgtttccykgacaacttatatatgcttaatcactggactttggcatgcagagccaaacatatcatggaactgaaagaaccacaatatgacatggtgacagaagactctttgaatcattattctgttttccactatcagctgctccagctcccttatactaatccaactttgtccctcagagcacccatgctctgaacctaggtttaatctctctgctgaaagatttattaaagatacttagataaattaccaagtctttctctacgatcatcaaagagtaagggaagtcaaatgctcatgggcagttgtccactattcacagaatctttagaaactatttgcctgaggccaaggagaatttgctttatcactaaatctgacccatgttgagccatactaaaactgcacttgggtactagtctcaaatcaaattgagcttatgtattgctctacatttattgcatcccatgctgtgtgcaatttctgatgctgaataagagaaatacggcaattnaaaggcttcaccacaagcgtcacattccatgggtttccttgggttttcacctctgcatggatcttctgatggttgacaagatgcgctgttgactgaaacttttgtcgcacttctcacacttataaggtttctctcctgtgtgtattctctgatgctgaataagacccgagtt

SEQ ID NO: 968 - DNA, 391 bp, Homo sapiens
  misc_feature (1)..(1): n equals a,t,g, or c
nttttcaragcagttcccatggcccagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttcaaaattgctaagacaataaatttcaaatgttctcacc

SEQ ID NO: 969 - DNA, 455 bp, Homo sapiens
  misc_feature (7)..(7): n equals a,t,g, or c
ggaattnccggggtcgacccacgcgtccgcccacgcgtccgcccacgcgtccgcaaatatattggcaggagattatccagaacatctaggtgcaggtaaacagttctaagtccaagaagttatggagggattgatgctaccacttctaagtgttatttattctgaaggaactgtatgggaggagatcattgtttctggaagacagtactattagttatatagatggttctttctggttctgaatgactaatcagtcattcagtcaataacactgaccacctactatatggtagtcattgttctaggtattgagcatgtaatggtggaagataaatggcagatgagaatcctgcatttagaaccttaagtctgattggatggcggaagaaatatagttgataagcataattttaggtagtgattcatttccaaaaaaaaaaaaaaaaagggcggcc

SEQ ID NO: 970 - DNA, 1128 bp, Homo sapiens
ttacaaatgattactacaggaatagtggccacttaatgtcagttactccggtggaagaatttatctagtttttttttttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaagggcggcc

SEQ ID NO: 971 - DNA, 1288 bp, Homo sapiens
  misc_feature (462)..(462): n equals a,t,g, or c
  misc_feature (813)..(813): n equals a,t,g, or c
  misc_feature (825)..(825): n equals a,t,g, or c
  misc_feature (834)..(834): n equals a,t,g, or c
cgatgaaggggtacagggagaaagattatttaggatcctgaggatcaatggagaaaaaccatacaactttgttgattactttcactgtgaatacatggtctactacctcaaccgggccctcagagctactttcagcattctgttttccgtagtttgcttgctcttcctgggttccatagtgaactgttttttaaatgatgtcttcaagccactgacccttaacttttccaccgcactctcagcatggagaaaagagtcatcagcctggaattcccttggtctcctaccaccaacagatgaatatcccacatgagcatccaccttcggcccctttcctagctcagtgggcttccttcctattagtgtctggttttctattccattcagttcctacccttcctgcctgctcagagtcctcacaccttatgtaactgattatcccctttwctgtttttggctttngtttttttgagacaagttctcaccctgtccccaggttagagtgtggtggcataatcattgctcactgcagccttgaactcctgggctcaagcgatcctcctacctcagtctcctgagtagctggaactacaggggtatgccaccttgcccagcttatttttcattttttacagctcttcttttaggttcagggatacatgtgcaggtttgttacatcagtaaatgcatgctgcaggagcttgatgtacagattattttgtcaccaaggtaataaacatagtacctgataggtagtttttgaataccctccctyctcccaccctccaccttcaagtaggcctcactgtctgntrgtccccttcnttgtgtccntatgtactcaaagtttagctcccacttataagtgagagtatgtggtatttggttttctgttcctgtgttagtttgcttaagatatggcctccagatccaaccatgttgctgcaaggacatgatctctgtctttttatggctacataggattccattgtctatacgtaccaccttttaaaatccagtctatcattgatgggcatttaggttaattccatgtctttgctatagtgaatagtgctgcagtgaacatactcatgcacgtgtctttatgtcagaaacatatttaaactaaagagcttctgcacagcaaaataagctataacagagtaaacagacaacctacagaatgggaaaaaatatttgcaaactatgtatccaacaaagatctaatatccagacgctataaggaacttaaacaaatttacaagcaaaaaaaaaaaaaagggcggcc

SEQ ID NO: 972 - DNA, 1264 bp, Homo sapiens
gacccacgcgtccgcccacgcgtccgctttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttcagttcttcttccgtgtcctggtttcttgttcagttttacttctaatccaccaccaaaagaaatgtctggctggtctcagctagagtctatgtgtcttagagcatgtgtgcgtatctgaccatcatccctgctctcatctcagctccctccaggctgagcaccggttccttttgtcccatacgtcatgaagtccactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaagcacaaaagtttattgctgtttgctaaagcaaaatagcagaaaattttgtatatgcaaaactgttgaaggaccatagagaatgtgtactactgcggggcttttactaggcttcctgcgtgtgtaaaagtcgaggtattgctggcattcagggtgacatgatggtactaaatgttttccattaaagtcttctattttaaaatttagagaaaaataaaatggctttccatcagaaaaaaaaaaaaaaaaaaaaaaaa

SEQ ID NO: 973 - DNA, 1260 bp, Homo sapiens
ccacgcgtccggtctttatataatgaaagagaagaaagtcacacttccgtcgagcagccaatatatgcctcattctgcagcaggtaatctaagatagatgtaacagaagcaatattaagaattagcagatatgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaatgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatagacaccttgggaagagatggatgttccacgaaaggaatccagtgaataaatccttgaagatctgtttcattgcactgcattcttgcattgtctttttaactgtgtcattaaagatcactgaaatcttcaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 974 - DNA, 1230 bp, Homo sapiens
  misc_feature (1223)..(1223): n equals a,t,g, or c
cagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttytgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcagccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaaaaaaaaaaaaaaaaaaaaaaagggggnccccttt

SEQ ID NO: 975 - DNA, 1202 bp, Homo sapiens
gggtcgacccacgcgtccggtttttttagaaatagaagtgcttacagatttgtttgagcagaatagatacccatgttcagagagagagagagagagccattgagaggcasagagtgccgaatgtgaattctgtgtaaattgaaaagttacggtccccgtccataaggagatggctctggttgtcttgaatttagacagctttccagaggaggaggttctctcctgcagcagtgtgggaaaaaaatctaccagatttggaccagaatgactgcaatttaggtcagaacatgatacttagagggaaaaaagtaatcatggcttgaatagctgccctaaggccagctacagggctgcagggtctgtggacctttcttgtcagaactcaggatccttaggagtccccacaagggcatggaggctgtggccatcatgagtggaagaaccagcttccaaaggaacctaggattgttctggccctggctccaggtgcatatctctgctttccgtgagcattgaatgggaaatcacgtgttagcagaataaatcccagaatacacattcaggaggagatggttccacatggcacgtaagtcctttgccttattgatgtttgtctggcagatgtccttaagccttcccatcaagggctttattctaagggtggctaactggctatttaaacctcatctcaatagtgtctgtctaggatggcaaaatcacaccaggttctgctgggcaaatctcccaggtggcgtattgctagaggagagcgccactgcagaggacacactgtcttggccactggctttgcaaaccatagtggaggagggagtctggggtcaccaaccacttcctggctgactgcctgagccacattatacaagactgtttgttgacttagtaatactgaagccagagctcaccaagattctgacatcaagcatgaaagtgactaattctttcawttcccagcactttgacaaaggggactctcttaaaactcctcatcggacgttagtggaagtcgactcatgtatctaaacatgtagccagcgtaagttcttggtcagattgatctaatgacttttttagcgtgtgtgtgtgtgtgtgtgtgtgtgtttaatctttttaagtttgggtgaagtttgaccttctagaattcctgtttattcctgagcaaaaaaaaaaaaaaaaaactcgag

SEQ ID NO: 976 - DNA, 402 bp, Homo sapiens
gcgtccggcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaacaaaaaaaaaaaaaaaaaaaaaaaaaa

SEQ ID NO: 977 - DNA, 419 bp, Homo sapiens
  misc_feature (2)..(2): n equals a,t,g, or c
tnataataatgtcttttccatcatgtctgactttagtaatttaagtcttctcttttttcttttagtcagtctagccaaaggtttgtcaattttattcatctactcagagaaccatctcttggttttgttcattttccttatatttaaggaaacaaccagaccagcagctttctgtgtctccgtggagtcctgctatggttctgggagttgcctctcctctctttctgtcgagtggcccggccagtgcatgtggcggctcctgcgtctccccttcaccagagtagctctgcctttacctgtttggcatttccatgtaacatttcttttgaaaagttggtttactgctaaagtactggctttcatacagtgaaaccccacagaacaaaactggagctgcatacaaaaaaaaaaaaaaaaaa

SEQ ID NO: 978 - DNA, 1180 bp, Homo sapiens
  misc_feature (1163)..(1164): n equals a,t,g, or c
gcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggaaaaaaaaaaaaaaaaaaaaaaaaaaaaaaaaannaaaaaagggcggccgc

SEQ ID NO: 979 - DNA, 1258 bp, Homo sapiens
ccacgcgtccgcccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaaccccttgtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaaaaaaaaaaaaaaaaaaaaaa

SEQ ID NO: 980 - DNA, 455 bp, Homo sapiens
  misc_feature (431)..(432): n equals a,t,g, or c
gtgctcagggagctgaatacacggctgcgggatgacagggacgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcggggrtgcccactcaggatgcaggctctccccagggggccccaggctcgcctgactgaagacatgaaggacctagcctaggagtggtcagggtcccgggagtggccagggtcccgtgtgtkccctctgccagtcttcgctctgtccccgttcaatcaaccccatctcagttcagcagaaaaccccctcgtcaaataaaacccactgactgcaaaaaaaaaaaaaaaaaaaaaaactcnngggggggcccggtacccaatttg

SEQ ID NO: 981 - DNA, 745 bp, Homo sapiens
  misc_feature (3)..(3): n equals a,t,g, or c
  misc_feature (27)..(27): n equals a,t,g, or c
  misc_feature (48)..(48): n equals a,t,g, or c
  misc_feature (93)..(93): n equals a,t,g, or c
  misc_feature (113)..(113): n equals a,t,g, or c
  misc_feature (163)..(163): n equals a,t,g, or c
  misc_feature (727)..(727): n equals a,t,g, or c
  misc_feature (739)..(739): n equals a,t,g, or c
  misc_feature (745)..(745): n equals a,t,g, or c
ccnccccccaaaaaattaacccgggcnaaaaaacccccggccctttcntttccccccccgggccgcccgttttgggccccggaattttccaantttaaaaattggccaaggcnttgggcacgacaggtttcccgactggaaagcgggcagtgagcgcaacgcnattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcggcacgagccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgccaaaaaaaaaaaaaaaaaaaaaaaaaaaaaaaaaaaaaaancycggggggggncccggn

SEQ ID NO: 982 - DNA, 601 bp, Homo sapiens
gctcacacctgctctgccatcaccgaggtctgcgtcacctttactctcacctgaatcgctgcaaagcccccaatggccttcctcctccctgtccattcattctctcccagtggccggcaagcccagtctcatcacatcactcttcacagagccctgcgatggcttcatggccatcagaggaagcaacactcaaggcttgacaatgatgacaatgacaagtgacaggtggttcagcatggcctgggcttcctgctctctgtcccgtccccctctaaccccctcctgctcttgccagcagcctgccactgtggccttgctattgcagacaatctctgtctgctctgcccagcaggccgaccccctctcaccccccagagcctgccgcccctycaggcagttccccgtcctycagagtgcgggtcctccccacagcccacacgtctatgcatttgtyctgtttcctgtcagttctcgctggcagggcggggacttctgtyctatttgctgctgtttcccccaatgcctaggacggtgcctggaacatacmagatgctcaataaatccttgktgaatgaaaataaaaaaaaaaaaaaaaaaactc

SEQ ID NO: 983 - DNA, 3173 bp, Homo sapiens
ggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctmaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccrtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttactkggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatrtatatatggggttttttggagtaaaggaaaattctaagatattaagacatatttttatgtagatctgatctatctgtgtttggtgaatttaatattctacattgatttttcaaactaaaaaaaaaaaaaaaaaaaaaaaaaaaaaccttaaaaaaaaccc

SEQ ID NO: 984 - DNA, 1530 bp, Homo sapiens
ccacgcgtccggccgacacagcccttgatgtggggaatgtcctagaaaggaggaagccacgggggcagggagcacggggactcggaggccttggggtccaaggggagccgaggggagctgtcaaggcccacagtggctgaaccatgaggagctgctccccagcaaggccggctgcagggcttggtgggcctgggctgggcggaaggctcctcccagcgtgggggctgctgtggggacagcaaggaggggtgcagcgagggcctggagaaggctcaggtgcagaccctcagccgtggggcctcctccagtcgccccacagcctgggcctggcacccccccaccaagccagaggggccgaatgccagggcacctcagctacacaaaggctcggacccctagcaggacctgggcgccgcggctgactggctgcctgacggagaatggagcctctctgtcacctgggccaacatgaatgacccttcgtctggtgtctctggggttctggctggagagccaaaggctggaaggtctggacccgctgctcactggggtctggatgccaccgtggagctgcctctggcgcagcgggagaacaagcagagccaccctggtcgtggggacggcacccgtgtggccggggctgtagccagtgaggccttggtgacgggagcggctggagtgccacgcggtgtcccccgtggtcccacagcagccctcacaccatcaaccggtccaccgcgtcccagccatcccaggagggggcggggacatctctgcagtgacaggaatcggctaggcgctggcacctgtgcgcagccgctcggccagggtttatgtgctcggcggagacagccctgggggtgaggagcgaagggagatccgattcaggggccacttggggctaagccatgtacgtatggccgaggccctaagtgagagctggcccagggctagatcacgtggccgtcgaggcccggcctgccgcacggtggccaccagccagagcccttgccgcccacccttcccatccgccgggacgccagcctcaggagtggggtcagatggggcctgtggccgggctcctcagccactgcccactgagctctcggccccccggccagcgccttggccaccactggtatagctggattcctgggaacacctagaaaccgggctgcttggaaacactgtggcgttgccatgtggggctcttcctccgcccgccagggaggctgtccccggtgcccggtgctgtggcccacacccgccaggttgcagaacgtgtgtccccctggcgaggccccccagaaccgtgtttttttttttctaaaggagctgactcggggccaagcacattcctcccggcccccgaggcttgctcttgtccagccctgggaacgcacaggcggccgagcccgtggcctggccgaggaggccgccgctctgcgaggggagcgctgttttccaggccggcgtctggaatgttgctctgccttgcggtgtgagccgactcctgcccccatttcagct

SEQ ID NO: 985 - DNA, 413 bp, Homo sapiens
  misc_feature (343)..(343): n equals a,t,g, or c
  misc_feature (385)..(385): n equals a,t,g, or c
  misc_feature (410)..(410): n equals a,t,g, or c
gaattcggcacgagcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttanaaaaaaaaaaaaaaaaaaaaaaaaaaaaaaaaaaaaaaaaanaaaaaaaaaaaaaaaaaaaaaaaanaaa

SEQ ID NO: 986 - DNA, 1396 bp, Homo sapiens
ggcacgagaaaaatatgaagtgcacagctgtgtttgcaccatcagcatggccaaacaccctttctcttctcgtttctctccacacagtgatgtgcattaactggcacctggtttctgcatcacacatgcatattgggagaattgttattctagaaggggatggaatgtgacacacctcagataattgctctgagaaatgagtatgaggtctttttaaaaaaactttacatttaaacacacaaaccatttaaaaaaaccactcctccaaaacagacacacaagtgaaacaaaccaaatcgactgtccatccatttaattttgaactatctgcaatatcaccttaaagctctaagctcctaatgattttggtcattacaaatccaaaataacattatttcaaaatgaagttttactatgatttttcccatttgggaaacagtatatccaatacaacaagatgcatgtgtacctccattaaaattttaacaattaggaaaattagaatttatatatgatagattaaaatatgattatttcctaaaagttttctttagttttacaggtttgcttctggattgctttcaatagttattagtgaatttaaaatttgattcagtatgaaggtaatgtacacccatcttcttcagaacacgtattttaaaatgtgacatcatctgttctgagtctaagcactgaagaatgaagtgtccacattcaccgtatttatgcacagacacattctcattccattgacatttaagtgatgtaatgaactaaaactgccacaaagagaggagggttgggaggctgagctctggacagctctgtcactgggcaagtaacatggtgtttagaaaatctctgctcctttctgtgccattggtctatatctctgttttggacaaaaaaccaaacaccgcatgttctcactcataggtgggaattgaacaatgagaacacttgcacacaggaaggggaacatcacacaccggggcctgttgtgggatggggagagcggggaggaatagcattaggagatatacctaatgtaaatgacgagttaacgggtgcagcacaccaacatggcacatgtatacatatgtaacaaacctgcacattgtgcacatgtaccctagaacttaaagtataataaaataaaaataaaaattaagtaaagtaaaataaaatctctgctcctgtttgctgtccccactgataaaatggtagagcagatcactcctaagtcagagcttgtgtaatagctgcgtaggagtgtgaaaccaggctacttgggagccagtgctggctccagaactttccagctgcgtgtccttgggkcaggtggtttacactctgttgcctcagtttctccagcaataaaaaaaaaaaaaaaaaa

SEQ ID NO: 987 - DNA, 1169 bp, Homo sapiens
  misc_feature (2)..(2): n equals a,t,g, or c
  misc_feature (9)..(9): n equals a,t,g, or c
gngcggccnccctttttttttttttttatattttatcaattttattgaaatattccaaggatcccaaccccatttaaaaataaaaattgtaaagcactccattcaataaaagcacataagtccccctcaataattagtatgacaattcacgatacagctcttactctgggagagtttattttaccctttattccaaaaggcacaaagtcatctgaggcctcagatattaaccccactgcatgttaatgacacaccactgaggtgcagctcaatgtaattattaaagcttataacacacttccccaagaatttatagattctttctataaataataatttaaaaaatactgcaccttaagaccaatacaggcttaacaaaagacctgaaatttctgcaagggcagttttgtttcttgatagaagtacaacttttgaaagtctattcccagcaaaagaaacactagacccagcttggccaaagaaacaaaataaaacaagtgatttctaacacgctaaaagagtacattttcatcagctccaaagaaagcagtcctggtcattcagaaggctcctatgatcccaccagtctgcagtcattagaaatatatgctttacaggccacaggctgctctggatttggtttcagacaccagtgaccagaagaagccagttttgcgtgtgaggggtgtgggcccccgctgccttgggcctgctcaccggggtggatggacccccgccgggtcacagcctgctgtcacgtctggactgttggcctcttctgcatctgggctgttgggctctcctgctctctgtccctcagtcacgtcattgtctggctgtccggtgctggctgcactctcatttgtgaggataaccccttccttcttcttttctcccaatacctccagccccatcatcctgagataatgaagccgttcattcttgggcacaaaagttcgaatggaggcctttccccgccatccgcataagacgatgggacactgcagagcgtctggattcgcagaatctggttcatacttcagcacgatgcttccctttgccaggtcctttgcttgactgtaggtctcactgctgagttttctaaaaaagggattttcctgggtcaacagtatcttaacatcttccattgatacagtaataattctttg

SEQ ID NO: 988 - DNA, 2694 bp, Homo sapiens
acgccttccaaacgtccccaaataaacctcccttgacgtcccttctgggtccctccctctgggttgcaaaaactcgggcaagtcttctgggcaacacaggaaatctggggggcctccccaacgaccgttctcttggcatcggatcagcggcaaattgcgctgggccagtccttcccggcaccggtagcgaagcacagtgtccacctcatagcgcagccgtgggcggccgaacacttgagccaggggcagctccggtggcggcccacaggacaccagccccatcttgcaggtgtaggacaggtggtagttgcagggcacgtcactccattgtccctgatcatgccacacgagtgaccacgcagttctctccagacaggaagtagctgtcaggctgcccagggttccagttctcatagagcagggggacgccatccgaccacaagaagtcgccttcgatggtcctgtcgttgagtccgatccactggtactcccggtaccggttgttgatgaagtcctgttcctcgggtgtgctgatgctggccagatgcgcgccgtacatccggcactgggtctctgcctcctcccagctccttcgtgtggaaaagtgcttgtagcaggcgccctggaaggcgtcccagccggggttgcagaagcggaggccaacatcgcacaggtcccccccatagccaggcagacataggcagcggaccccttcctcctcctccaagcatgtcccaccattgtggcaggggctggggacacagtcacctgatgcggggaccacggccactccacctcggctggcgctgtcagtgggcagcactggctgggcctgcactgaggtccctgctggggcagttcttccagaattatcttcagagggggcctccagctccctggtaccctcaggggcccgtgtggctggaagcagggaaggggcaccctcggagcttcctgtctcctcgctctctcctcgagggaccccagatagctcaggaccaccagttgcctcccccacctctcttgcctcaaccagagtggaaggtgatggggatgctaggttcctctccctgggagtgggcagagtctcagtaggtggtccatggacccttggaggcctggaagcttctgactctccatcaggaagtggtgatgcaccaggctgcaggactgcccttgctggcgcctgggagagtgactcctcctgggctgctggctcagtggggagagaggcctcagggcccgggctgctgagctcgctgggccatgcccacagagcctcatcctccacctcctcctcttcttcttcctcctctttctcttcttcatcttcatatttctcttcttcctccaatgccttaccttcctcttctgagaaccccgtgggcggtaccatggattgtgtttcaaattctaggagcgtcctaggggcctctgctgggtcttctggagtggagcttccacctcctccgtcctccatgatggggatggagtagatggccccacgggattcactctctgtggcttcctgaggcagctgcagttcctccagggtctctgtcactgtgacgatagcctctagtccatcagaggctgggttggaggctgggttggaggcctcagggatggcagaaaggctgggccgagtctcggaagcagtagacgttgaagcggctgtgcttattggggaagccagtctggttggggaagaggaagagagtcttgacaccaggcaagcccccaccacagcgctggctgggtgtgacgatggggtagcgcacactgccatcagctagccaccctgggctgcagtggtccaggccaccatcccaggctgcatacagttggcccgtggtggcaatctctgcaccccgctcctggcagtacgcccgtgcttcctccaatgtcagcttctctggagggtcacccaggaacagttctccatttaggtcttcagcataacagtacacatcatagaggtcatccgggtccaccacaccatagttccggaccccggggaagccatccatgtctccgtaacaggcctctcgtggggtctggatgggatacctttgaccttgacctccacagcgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgagctgtctccttccagaacatctgctaaagctgcaggagcctgggccaggaccagggctgccagcaggggcaggaacagctgggccatgctgcaggctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcactcgtg

SEQ ID NO: 989 - DNA, 1770 bp, Homo sapiens
ggcacgagtctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggccgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagacgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagcccaagtggatttggtacagtgcggctgtctaataaataatcaaaagcatttgataaaaaaaaaaaaaaaaaaaaaaaaaaaaaa

SEQ ID NO: 990 - DNA, 556 bp, Homo sapiens
ccacgcgtccgggcagctcctgagactgctggcatgaaggggagccgtgccctcctgctggtggccctcaccctgttctgcatctgccggatggccacgggggaggacaacgatgagtttttcatggacttcctgcaaacactactggtggggaccccagaggagctctatgaggggaccttgggcaagtacaatgtcaacgaagatgccaaggcagcaatgactgaactcaagtcctgcatagatggcctgcagccaatgcacaaggcggagctggtcaagctgctggtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccgcaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 991 - DNA, 2757 bp, Homo sapiens
ccacgcgtccggccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctggtccctcctctttggcctccgcttctcctatgaggataaggagttccaggccgtggtccgggcagctggtggtaccctgctgggagtcagctcccaggggggtcaggtgagtgggtgggacccctctccaactaccttccctgaaggttcctgccaaggtcccatgagaactagctgcccttctccccacagacctacgagatgttctcctggttcctgcggcccctgccaggcccccacaagcagctcctccaccacatcagcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccgggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccacagatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 992 - DNA, 2157 bp, Homo sapiens
ccacgcgtccggcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacactgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctagaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgagtgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcaccaaaaaaaaaaaaaaaaaaaaaaaaaaaaaaaaaaaaaaaaaaaaaaaaaaaaa

SEQ ID NO: 993 - DNA, 1794 bp, Homo sapiens
gaaaaagctatttaggtgacactatagaaggtacgcctgcaggtaccggtccggaattcccgggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggcccgcgcacctgcgccgcacaggtacgaggcggtggcgggctccgaggcgggcgcgcagctgcacccggtcatcaccacgcagagcgcgggcggcgtctacacccccgctggccccggcgcgcgaactycgctcaccggcttctcctccttcgtgtgagcaaagcgccgcgcctccctcagggcggaacggaggcaactttccggagtctatttttgktaagacaatcaactccaataactgagctgaagtttttgkttaaaaagaaaaaaatctgataagtgatgattttacctacttgkggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcargttcctgacggccaggcagggatgctaaggtgtggctcarccgtcactgtctgtgtcactgcagtggtgcggtcctcaggcttttctgsctgkctttcccccttccttctyamctgacagcgagggagagggaagcctcttagggctggaagccaccacgctggccctctccttccccgaacmcagcacacggtcaactccgcgggacacgaggacacgggacggcgtctccagaattgcttgttwcgtaggaagcgtgcattgttaaccagagtatttttaaaatctttttatctttttttaaactatgtcacatgaaatgaaaaaaaaaaaaaaagggcggccgctctagaggatccctcgaggggcccaagcttacgcgtgcatgcgacgtcatagctctctccctatagtgagtcgtattataagtaggc

SEQ ID NO: 994 - DNA, 1673 bp, Homo sapiens
  misc_feature (1671)..(1671): n equals a,t,g, or c
ggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccrctatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagtttttacttgaaaaaaaaaaaaaaaaaaaaaaaggggggncg

SEQ ID NO: 995 - DNA, 634 bp, Homo sapiens
gattaatcccctcaaccttctttctgagttcccatttcacagatgggtaaaactgaggtttactcctcgtctagcttcactgaatggcagagcccatagcttgtctttgcctaatctgctgcataatcatttcagcaacaactcaaatgccttttgagggttcttgcttctgtttggtgccttgtaattttcaaccatattttagacactttaggcctaatgatctaaggcatatggtttttacccatggtctgtgggcccttgagaagctgagtcctctgaaagaaaatcagaatgttgcatgcatctgtattttttgtcttagatttcacttgattctcaaatggatccttgactcccccaaagtttaatttattcaacaaatcttttttttcctccatactttttattctgaaacatattcccccaatttttaacttctgaaaaatttcagacaagttattggaatagggtagtgagtatctatgaacctttcatataggtttactttaaaaaaaatacaagagacagggtcttgctctgtggcccaggctagagtgctatgattgtgccactgcagcctgggtgacagaacaagaccctgtctttaaaaaaaaaaaaaaaaaaactcgta

SEQ ID NO: 996 - DNA, 1066 bp, Homo sapiens
gaattcggcacgagcaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgkyycwatattattagacctgtaatgttttaaaatgtattttattaaatttggactggatgtatgkcctctagcaatacgaggtactttctaaactattaagggaggggttgtaycctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaaraaaaaaaaaaaaaaaaaaaaaaactcgta

SEQ ID NO: 997 - DNA, 1151 bp, Homo sapiens
cacccacctcagcctccgaagtacctgggactgtaggcacaagtcatgcctgaccatgccagctcattttttatttattttaattttttttgtagagatggtgtcttgctgtgttacccaggctagtctcgagtttctggtctcaagtgattttccagccttggtttcccgaaatgctggattacaggcgtgagccaccatgcccagtttaaatagtaatctgtaaagaacagctagcactctcatgagtgttccatgttgagactctgttctcagcactgtatatactgactcatgtgatcctcataataaggcacaaagaaggggcagttattcgtacagatgaggaaaatgaggcatagaaaagtttggtaacttgcccaaggtcacacagcttgtttgtagcagaatccggataaggcttgtgcactgaggtggcatttgcagcttccctgagagggccctctgcacacatcatctctgatcctcagacaaccctgcagagaggtgggaggtgttgtaagctccattcctccccaaactggcatcacccagcaagctgggattcagaccaagggtgccagactccagaacccgtggtcttgtctctgcacctcagtgcccgtcccccgccatggtctggcttcctttcctttctcctccaagtctccttctcactttgctaccatctttgctctgagcagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggtaagcagcccgtggctggccctggggcaggcaggggtgccggatcctggcagaagccgagggtacaaggcttaactcttgacactgcacatggggtggctgtgggccttgttttagagacagagcctcgctatattgcttaagctggtctcaaactcgcgatcgtgccactgcgatccagcctgggtgacggagcaagatcttgtctcaaaaaaaccaaaaaaaaaaaaaaaaaa

SEQ ID NO: 998 - DNA, 1615 bp, Homo sapiens
ggcacgagctcgtgccgcttaagtttacaggttcagatagcttttctcacaccataggactcgtctatcatttttgtgtagtttttcttttttaatatggcttgtcttatcagatttcctgctattggttccctcccttattccacctggcccttctttttctttatctttttatttttctcctgtttaacttttattccattttctccactttcttctttctgtgagccataccctagaaaagaaccctagtgggccagagttgagatgcaaattcttagactactctagccccttgaactcactccatattggcaaagccagaaatcctgactgttttacttgctgttctcaaatcaatccatcttactttccagggaatatcttctgtctgctttggatatgattccagaagccatgtcacttctagtaaattactctgccttccctgtacactttcaaatttcctagggcctcttgcatataaagtggaaggtctcatctctaaatttctagtagaatccaactaaaaacacataccctgagctgagacccttctctgagcaaaggaactcacccagtcactctttggaactttcaagtcgtgctctttgtacgtatcatatatactatgaacttgttttctcctcattgaaagataagatgtcagctttgcatgtttcctttattccagtggagatccttcagggtttggtgagtggaaatctgggaggcacacttgggccgactgtcagcagccccattgagcaagatgtggtcagtcccgtttccctgccccggagagcaaagacctttggaggatttgacagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtacattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgttaagatttcaataaaactaaaaaatctattcaaaacattaaaaaaaaaaaaaaaaaaa

SEQ ID NO: 999 - DNA, 784 bp, Homo sapiens
  misc_feature (56)..(56): n equals a,t,g, or c
gatttttagtactgctatactcagttgcctgtctgtagtacccctgtacgtagtantcttttcttacaactctgttcccagtacccctatgtttagtcccttgttctcatgttctcactaccccaatacttaatatactttgttctcagtatccttgttgttagtaccctgttctcactaccccttttcttagtacccctgaggggggaaaaaaaggatgataatggggtataagtctcaaaaaacttttggattgtttgatttgamctgrgtcaaaggtaaaaccagtgttctggagttcgacttctgggtgcaaatccctgttgcatcattactggccttgtggctgaataggttattaaactctgtaaaatgggcattaaaaycgtgtgtcattcatagtgttgctgtgaatawgtgagccattccatattgagggttcacacagtgtccagcaactggctaaagtttgcaaaccttacccattattattgtcattgttagtggtatactttgaggctgtcacaaataagcagatatttcttcttgtgagagctatataatcccttagtgtagagaaaaatttaattttgttacaagtgatccaagccaggtatggtggcaagtgcctgtatacccagctgtacttgggagggtgaagtgggaagattgcttgagaccaggggttcgaggctgccgtgagccttgtttgcatcactgcattccagcctggatgacatagcaagaccctgtctccttaaaaaaaaaaaaaaaaaaactcgta

SEQ ID NO: 1000 - DNA, 813 bp, Homo sapiens
gaattcggcacgagtctcaggtatgtttaaacccaatgtttctttgttaattttctctctagatgatctaattctgagagagagggaaaatgaatatggggaagtctaaaaaatgaaaaaggggaaaaatgaaggaatatgcctgctgtttcctaatgagtagctgaaagtcttcaacctatgaagcctcctggatcatctgccaattgttcaacacaactcccacccctgccttcatcctctttccctgattcacaccctcatggcctcttttcattacagtcaaggtccatcccagctttgacctcatgaatccattatgccctcctctgttactgctagacctgcagacccagtgtccacaaagatgctcctatattctttattcctgcttctctggaatggttttaatgccccctaaagcaccagcwtgtgaatcgacctttgtgttcatatcatggagtcctcttagctccttggtgcctccaaggccaagcttccatcacctgccaagacacagcgagctggaccaatatttgtgtggcaggttgggtgtgacatgaatgtcaaagccaccctgaattgagggattctgctcccctttgttgaacttcctttgggtggtaagccagacattgtcattcagcaaacatggtttcaataaatatctagatgcaatcaagagaaacatgaaaatgacatggcctcagtcctccaagagttcaaatctaacagaagggacaaaaagtgtcttagcctaagatgattaaaaaaaaaaaaaaaaaactcgagggggggcccgtaccctctcgc

SEQ ID NO: 1001 - DNA, 648 bp, Homo sapiens
gaattcggcacgaggcaatatttgcctcacccaacaccacaaagattttcttctgttttcttctagaacttttttagttttagggtttatatttaggtctgtgatccattttgaatcaatattagcatatgaggcaaagtggagatcgaagtttttatttttccttatgaatacccagttgttccaacaccacttattaaaaacactatactttatccactgagtttgttttgtaccttcatcaaaaaccagttttcaatatatctgtggattaaattttttatttttatgtttatttttagagacggtctcactatgttttccaggctggtctcaaactcttgtcctcaagtgatcctcccatcttggcctcctgagtcgctgggaggatcaggcaggaggatttcttgagcctgggaggttgaggctgcagtgagccgagattgctccactgcacttcagcccgggcaatagagtgagatcctatctcaaagaaaaaaagagttattgtgttatatcttttttaatccattttcttttaaccctttatatccttatatttaaactagagtttctgtcaagtgcactccagcctggtgacaaagcaagactccgcctcaaacacaaaaaaaaaaaaaaaaaactcga

SEQ ID NO: 1002 - DNA, 1008 bp, Homo sapiens
  misc_feature (421)..(421): n equals a,t,g, or c
gcggcacgagctggaggtcactttccaaccagagctgtgctggagtccagtaggtgggaggctgtgctttgagggactaaaggaagcctgtatcttgtggtgagggttccacctcacaagttacagatctcagttccatttggctctagcagcaatgtggccacttctgttgcggttactctttcttcacctttttcttgccaaaaataaacttatctttaaatgaaaactaaattatttcttatattttggtcctttgttatagctgagattgggaatttttctttctttcttgaatccttacttccctaccctgcctccccaccaatggaaatctgtgcttcataagcattttagattccagaaagctctttaggttaaactacaaccctctcacctcaaagaatttgtgggccagggnaagtcagtgacttatgtgaagtcttgcggctaattaatggtagagctggagttaggacacatgtctcacagttcctagttcgttttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaaaaaaaaaaaaaaaaaaaaaaaaaaaa

SEQ ID NO: 1003 - DNA, 736 bp, Homo sapiens
tcgagttttttttttttttttttttgagactgaatttcactcttgttgcccaggctggagtgtaatggtgcaatctcggcctgggcgacagagcgagactccgtctcaaaaaaaaataaataaataaaataaaattaaattaaaaaaaaaaaaaaaaagtctgctttgaaaaccagtatccatagacttctggcagtcatttctggggtttaattttggatgtgacaaaggtttgtttccactggacttaattttttcacatcgctctaacttttgaaaacacagatacagtccttttgctgaataaaatgaaaactcgagcctaaatttaaaggcatagatatttcctggacttccaggacagtaatatcatgtactactttgtcaaaaaaattttctggaggtttttctagaggaagaaactaagataacaacaacaaaaaagacaaatccaaatgcattacttgaagagcgactactcatgtttctagagaattttttggtcatactatgtcatggggttatttcctgggggcttcagttctgcttcagaatttctttagtagttatctactgaccccatctggtaaaattatagaggaagttacagtcgttaaagcttctgtcaactcgatttctaaaaattttatgtaaagagatattttaagagaaataagaaaataggagatcagggcaaatgaatctaaagatctttagctttactcgtgccgaattc

SEQ ID NO: 1004 - DNA, 895 bp, Homo sapiens
ggcacgagcagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaataaaaaaaaaaaaaaa

SEQ ID NO: 1005 - DNA, 505 bp, Homo sapiens
attacccttccactaaagggaaccaaaagctggagctcccaccgcggtggcggccgctctagaactagtggatcccccgggctgcaggaattcggcacgagtcacaatatgaccctaacctacttttccaaactcttctcttacatcctttctcaactattataagcaccagtcatactgtgctgctagacatacacaaagaacaacatgcttttctgtgccttgggcatgacattttctcttccatgcacttactttttaactccttgttttgtttaattagcaaatgtttattgattgcctgcaatatgccatgtcctgtgctaggcagtgaaagtataaagataaataaacaagaccccgatatgcaaggagatcataatctagtgtgacagactaaaatataaataaataattataataaatcttgttaagtgctaagatatgagtttgaraaaaaaagaaaaaaattccgggacaatggaaaaaaaaaaaaaaaactcga

SEQ ID NO: 1006 - DNA, 505 bp, Homo sapiens
  misc_feature (12)..(12): n equals a,t,g, or c
  misc_feature (501)..(501): n equals a,t,g, or c
gctccaccgcgntggcggcccctctagaactagtggatcccccgggttgccaggaattcggcacgagttcatctattgaagggtgtttgagttttttcactttttggcttttgtaagtgatatagtttggatctgggtccccattcaaatctcatgtcaagttgcagtccctagtgttggaggtgggcctggtgggaggtgatgggatggtagggttggcttctcatgaatggttaacaccatcccctttggtactgtctttggcatagtgagtttgttctcctgagatctcattttttaaaagcatgtggcacctctcctttcactgtctcttgctcctgctcccactatgtgaggtgactcactctttgtttgctttctaccataattggaagctttttgaggcctctctagaaacagaagctgctatgcttcctgtacagcctgcagaaccacgagccaattaaacctttttctaaaaaaaaaaaaaaaaaactcgangggg

SEQ ID NO: 1007 - DNA, 1947 bp, Homo sapiens
gaattcggcacgagttgtggtctatttaatgccatgcttttcctgtttttgtactgtttgttggttgttttgccatttaaattaacccccaagcatagtgctgaagtgctgcttagcattcacaagtccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggcyggaaagcmtgaaaggataaaatatattgaatttaaaaatctacagttatcctacaagcaytggtgcgtggttggytagtacgaaaaagatttttagaacagagagccaaaattscgacttccttccacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatattkgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaargaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtwaacattttcagtatgtatagtgtwaagaaatattaaagccaatcatgagtacgtaaagtgatttttgctctctgtgtwcaacttttaaaatctgactttgttttaaaaaaacataaactgttcattacattcttcatttttatcatttatagttttatgcatgtaataaactaatatgtcataagatgaaaaaaaaaaaaaaaaaaaaaaaaactcga

SEQ ID NO: 1008 - DNA, 1916 bp, Homo sapiens
  misc_feature (1558)..(1558): n equals a,t,g, or c
  misc_feature (1592)..(1592): n equals a,t,g, or c
  misc_feature (1679)..(1679): n equals a,t,g, or c
  misc_feature (1728)..(1728): n equals a,t,g, or c
  misc_feature (1799)..(1799): n equals a,t,g, or c
  misc_feature (1876)..(1876): n equals a,t,g, or c
  misc_feature (1891)..(1891): n equals a,t,g, or c
  misc_feature (1905)..(1905): n equals a,t,g, or c
ggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctgcctctctggggtgggtctcaggccccacccctccctmttttgagttcagtgccttgctcagcccctcccctgtatctcagcgtcttsagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctgggaaccgsccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgcgctgacggcaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcangtggcaccatgacgggcccctagccacacagctngtcctcactacggggcagggagcaagcctcggcaacaggcaaaggccagaagtcagaagtggtggggaaggacaaggggctggttgncccggttccttggaaaagccacttgcaaaaggggcaatggcttggcaantggccaaggcctgggggggaaagtggaaagcgtcctgtcttgggggcaagaattcccaagccaagggtganccatgggttaaagggccacttggaaaactttgaaaaaagctttggaaaccctttcaaacttggggcccaagggggtnaatggaaaactggangggtaaacctccgnttaaggggcaa

SEQ ID NO: 1009 - DNA, 580 bp, Homo sapiens
  misc_feature (557)..(557): n equals a,t,g, or c
  misc_feature (569)..(569): n equals a,t,g, or c
caagaaagtttgcatttataacacaagtaacacatgttaagtcctctttcacaatctctgttagttgcactcaatgttctttttctcctcccaaacttcttagcactttctaaaaacctgacctacgattgttattttaggttcttcccaactttttttctgcctcccaaggaaatgtggtatctctgacttccacagctctcactttgattcataacaccaaggcttcttccccctggagtgggagacacaatagggatggggatgtgggcagaagaagaggattctatgaatatccatagttttatttcacccaccccaaatgtatttatattaaaggacccactgaagagcgctggtgagatggtagactcttgtctgaagtccttatgctacaccaatataatcttcttcttaggccttctcccactaggtgaaaggggataagcttcgggacatctagaaaggggcattaatttccccaatcctatgagctacatttgagactcacagtattagaaagccggggctttatcacagtctctttggaagaagcnaaatttttttcnggacagctttc

SEQ ID NO: 1010 - DNA, 1176 bp, Homo sapiens
tttgattgttttgtaatgctcaagtttctgtcattttcaaatatgttgggcttgttcttcatggcaaacctagaatcctagactgccgctccccagaggaggttctttaagactgctcagctctcctgccaatagcaacaatgcaaaagcttaccccttctcccgtttccccagccccatcttcatgtcctgtggatgttgcttcatccacatttataatttactcctgtctctctgctatggtttgggtgttgaaagagtgaagttctttacctttagtattttaaaaaaagaaacaatgttgctcaattatttattctaaatatgttgttgggctttgctttatttaccctgtttgcatgtcttgttgatgtcttttcagtccttatggcccatcgacttccttatccatgacccagagaggccccagtgatattttgacttttcaaatgtggtgaataagtgagagttgtttgttgagttaactgtgattttaaatattctgattgttgtgaggcacttttctaggtgtttgatttcttgatctgttttcttctatgccaattgattaaacagtgtcttccacagtttgctaaggtgatgatggtgcctggttgttggttttggttggttgaataaagccctgatgctgggagttcattgttgtaggtggttcaagtggtggagtcctgtaagcattcctgtgtattcttctctgaataataatgctgcatattaagcctagcatcctacccatattaccacataaactgttaggtctgtcctggcttcaattcatgttggcgttcaccttaaattttaaaaataaagtttatgtttatttgaggggcaagtgactatgttgtaagaatgatatttttctgaccagtagttttattttatttttactttttatttgttccaagatggagtcttgctctgtcacccaggctggagtgtagtgacacaatctcggctgactgcaacctccacctcccgggctcaagaaattctcctacctcagctactcgggaggctgaggcaggagaatcgcttgaacccgggaggcggaggttgcagtgagtcgaggtcgcaccattgcactccagcctgggcaacaagagcaagatccgtctcaaaaaaaaaaaaaaaaaaaaaaactcgagggggggcccg

SEQ ID NO: 1011 - DNA, 1825 bp, Homo sapiens
ggcacgagcatgtcacatgtatacctatgtaacacacctgcacattctgcacatgtatcccagaacttaaattataataataaaaaaagaataattgggtgatggcacatccaggtttgccaaagacagtcccagtttatgctgttgtcctggcattattaataatgacactgcctttaactctcacaattaatttggatgataacttatatggtaactctgctaaataaaaaaaataaaaattaccatagtaacaggaacctacttgaaatgatgcctctgtttctattctggcttgaattctgcattctttgaggatttgtagcctcatgacagaatcctatctacaggtgatgtatttcatatgatttttggctatttttttaacaatctcaagcccaataatagccagtgatataaggaatgtagttactttctccccactttctggcaagttaagtttagccacctgattacaagaagggacattcagaggtaggatggcacaaagacacagggtccactggagatcactggaagcagctgcagcagggttaagagaagggagtcccagcgagtcttcagtcaccacacactaacatcatcagtgaaaagttcctgggcctgaagatccagctatgttgtttctagttgactattttaagtgacagaacttggcccaagcattgaccattttggttcctcaataagcctgattcaaccagggtcacctttgaatctgtcctccacctttccaataaacctattttatgcatcattcagtgagttatttatttatttacttttttgctgagaaacatgactagatttaggaaaaatgtagaattttacttttttttcaatattttctgggttttccagagttttcacgtgtttcacaccttcctttgcttcccaccattcccctttctatttggaactagagagacatgagtttgaattctagctgtgtaacctgagtcagttatttaacctctttttgtttctgtttctttgtctgtaaatagcaaaaactacaattaactttagtccctgctgtacaccaaatgttatcttgaaatattatacatattatatgtaattactactgaaatgctctaagatgcctatgtgtgaatggcattgttgtaaagattaaataatataagggaagtgtctgcttcagtgtctggcatataataaaagctattatttttacgattattttccatcttatagaagaattatcgttcttcccttccaaagctaataaatggacatgtgtttatcagacagaacgtaagagctgccaaataaatagggaataggtgctttcgggagtctagggaaataaaggtcagggaattgttcataaaatttagtacccataaatagcctataagtagattccctagtttattctatgcaggaaaataaagttctacggagcacagattccaaaactaattggtcataaatatcacctgaaagtttagaaaatgtagcatcatggacctcttttcataggttctaaatcttaatatctgtgggatggtgcaggaatctagctttgctaagtgccctcagatgactcttgctgttctaggctaaaatacatgtggtttggcttcaatggacatgttcctgaagaatgtttggatgtcacacattcatatttagtatgagagatgaggtcctcctctcatcattttcttaggttctcttctctccactccttaccctcccatcacttacaataaatcttttagaaaattagctatacatttgtttcattataaaaaagaaagaagataaaaaaaaaaaa

SEQ ID NO: 1012 - DNA, 1137 bp, Homo sapiens
gggctttttgtcaacctgaagcacgttctaagtcgatggtagaaagtggacacccccagaagacacttttgcccagaaatctctttcttcctgacccctcttccccagagtgcccggaattccactgtcagaaatgcattgtctgggttaaaaaacttaacacctgctatgatttcaacagtgtcaaaacaggatacgtcaaaactgggcgaggaggaaatgtatttgggttctaggatagtgaaagctctattttttctacttttctgtattttccatatttggtacaatgagcacgtacttagaacggttttagatttacgaaaatatgcaaacacagtacagatagttcttgcgtcccccatgcctagttcctctattgctaacgtctcaacgttagtgtggtgcgtttgttgcaatgggtgaatgaatattcgtgggctgttattaaagtcagtgcttcacccctatttccccagctttcctcttacatccttttctgttccaagatgcatccaggatgccgcgttacattagtcttcacacttccttaggttcctcttggtatgatggtttctcagatttttcttgtttttgataatcttgacagttcgaggagtatttgtcaggcattttgtcaaatgttcttcaactggggtctctggtggttttctcatgattagtctgggaatgtgcttttgggaggaagaccacagagatgatgtgccagtctcagaacatcgtactaagaaaaggttctgccaacttgacttaccactgttgctggtgactttgagcccccggctgaggttactcctttgtaaagttactctttttttctcctttccatgctgtatgttttagaaggaagtcactatgctgctccaagcaactcaagtttgatgaatggggagttccgccccacctccttgagggcagagtagctacataaattacttggaatttctcaaggagatttgtctgtactcccagtttattatataaataaatgatttatttatattacagggacccagggatctttactgtatgctttgggttataatccaatggtactttactttgtggctcaagtatactacttttaaattggaaaaaaaaaaaaaaaaaactcga

SEQ ID NO: 1013 - DNA, 1775 bp, Homo sapiens
ggcacgagcagcagtccacccacgttggcctcccaaagtgctgggattacaggtgggagccaccacacctggcccagtgcattctaagggatgttggccttggagccagggaggagggtcaggtgcagatgctgagatggcacctctggtcgtggttctgttggttctgcttgtcagaagctggggtccttctggatcttcccacctgaccgggcatgttctggcaccctgtgggcctttctctctgcacgctggtatctctttgggttttctccacattggctgttggctgcagcatgtttggctcagggaccctccggtgtcactgcacgatgccttctaggccttctcccaccgtggaatgctttcatccctcccggtggggagagagtgcatgctcagcgaggctctttgcagcaggtgttcaggaggcctcggggtggagggcatccagagaggagggcccccaccctgcactgcgcccaccaggccctgacctctgcagccagggtggtcagtgctgcgtaccactgtgggctgtctgtggagcaggcctgtgtgcaatggggcctagtgcaatgtggggtcatttagctcaaggcaacatgaaaacagccccaggtctccctgggcagagccaaggcagatcctgcttcccaatgcatgctttgtggacagtttttggctcaagaacatggttgttcaatacgtagacaccttaaaaggggttttgtccctggatgcccatttttctcctgtgccagaaaagggagccagtgctgaccatggcgggggctgacccacctgagggtgcgcgggaagttgtgggggactgaggtgaagccgccagggcacccatgatgggaggtgggctgccccagctgtcccgtgggctcctgggcagtattgagccctgtgaggtgaaaagcgaatgtggggattgctcaggggctgaccactttttagtccccctgtcccaggcacacaccctcagtttgaatccttcttggttgagatgtcttcttggccacaggctgagggtctggatggggcaggtgctcgggctacccagagggcagggccgttgacccaagagcaggctgtgggagatgtggccatgtgcctgtggtctgcaggagacgtgagcttccccaaggtcacccagcaatgagcaggcagaacagactcaatccacacggccccgacccggcggcgcctcatcgtgcctgtcgcctcttctccccccgcccaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggtgatttccagcttgcctgtctccgagcatgtgctagccacgtagggcctcagtggtgtccccaggagcacgcccgtgttgtgtagaggggttgcaagctgtggcaaaggctgttgagaggcttcttttaaaaaggataaaaaaaaaaaggtgtagtctttggatgaaaggaatggaattgtcccatccaccaccaagtcttgcttgtaagcagctcagggggaggattgcttgagcccgggaggcagaggttgcagtgaggcgagattgcaccactgcactccagcctgggtgacagagccagaccatctccaaaaaaaaaaaaaaaaaa

SEQ ID NO: 1014 - DNA, 1341 bp, Homo sapiens
gtgtgccctgagactgaccttgacaatgttcatccctcagctgcctgccttaggactgacttccttgatgatggccatttccttgaatgtgtctgtttctcagggtctgtcctctgcatgcatgcatttgcgcatgcaggcatgcaaacccacaagagtccaggctaaagttttgggggattgggtacaggaaaatcatgtcattgagaatggggcaaccctgaggccatggcaggatcccctgcatgacaaatatagaatgaagtaaaaataatcagaggaagccgggccattgatgatgctatcagtcttagtggggtgatacaccagacattctgtctcatttctcttcaaacgaccgcatgagtggtcatggaaactacaagtcacacctctccgtatttggaaaagcagatcgtttctctgacataggagtaataagctttcttgacattttgatagcagtgagggaagggaaaaaaggcagggaggarctggaggtggggtgaggggtagaagccgtcatgkgtcctaragctctctgtaccagcgttctggtcaactgtacagtattttcttcccactcctcaggcatagcttgggaaccaggaacagcagaacccaagtggtctggcaaagtgtttgaatggtgctctgtcacctagtgccaaaagcagattgctacactgaagggagaaaggctcttaaaagagaccattgtgtttaatctcactgggatggtcagttcctcttggccttcctgtttgctccgtagwtgcgaacactagtttcaggggggtcaggctcccgatctgcgtcattatcctgtttaaatagggaggggcaggccctttcctgctgtctgtctcccatagtctctggctrtgaggcttgagtgacttggacatgacatttctctttctggttcattcattttccccacttccatctgaaaattctaaccaaatgtcttgctgaattctctaagtacaacaatttcaccctccctgcagacaatgaggraatcagagtccagaatccatttcaacttagcaaacatttactgagtctatattttgtttcggatactggggtaaagttctggaaatgcaaaaggaatttgcatctctgaacttaaggagttcacagtcttgaacagggcaatccaagttgtactgtaaagaaatagtatgatcgagaactgggaaaggaaacagcctttgaatagatacccattctggttaaatggaagatgggtttcgagggaggaaggaatttaatgcaggaaagccaattgggaagcaatttctgtgctacaaaaaaaaaaaaaaaaaaactcga

SEQ ID NO: 1015 - DNA, 1149 bp, Homo sapiens
gtaaaagttaaaaatgtttgccttttatgttcaggttttaaatcaatctaaaagtatttttgtatacagtaggaatctaattttttttatccatatgatagtcagttggccctcctttcttcagttacctgcagtgcatcaatgtcatcagtcaagtgtccatatatgtggtgtttctgggcttttcccctcttccaattatcagtgtttatccctgtgtcaaaatcacacagtattaattattacaactttatagtaagtcttaatatttagtagggcaagtctttttatttgataagagtatctttgctattcttttacttttactcttctgcatatattttagaatcagcctgtcaaattcctcaaaagactgtttggataaatttggaattacattcaatatagatcaatttgggaataaccaagagttttgggatattgagtcttcattcattaacatagcttttctcttcatttatttaggtcttattttttcatagagctttaaaaggtttactataaaatctttaaggggtaaactcttgaataaggtccagagttaaatagtggagagttacaggtgtctgtttgccccaaacagactgatggtatttcagccatctcaggatttggggaagtcagcacaaggatcaaaagactgagaaagtttaacttctcctctaggatgtttttagtacacacattatatttataaggaaacatattgtaaataatagagtgataatggccacttacctgagccttattataaacagaaacaaatatccaaccaatgccatagagcagaagtacagcctgaaaccaagaagaaaaagagcaattaaatcaggatctcatctaggccaagcttgaaaaggaagcttatttcctatttgtcttctgcctaatgaatgtgtcattactggggaccttaccaataaaggtgcttggatacattttccagcacagaaacttaatttgcaggaacatgatctttacttgtaaaaggatacattcttaattcgggatggttatttgagctgattttcaaggcatttatttttaatttatttgtcagatgggaataaaggtggtttataattaaatttaaaagatagtttaaaaaaaaaaaaaaaaaaactcgag

SEQ ID NO: 1016 - DNA, 884 bp, Homo sapiens
ggcacgagccggctctgctgccccctttctctccatggcagcggcccggaacctgcgcaccgcgctcatattcggaggcttcatctccatggtcggcgccgccttctatcccatctacttccggccccttatgcggctggaggaataccagaaggagcaggctgtaaatcgagctggtattgtccaggaagatgtgcaaccgccagggttgaaagtgtggtctgatccatttggcaggaaatgaggctgtcagcaagtctgatgaggaaagtggacgtctttatcctgtgcactccgcagtggggacaatagatgcctcactgtggcagcatggcatggagagggaactctcatgctgctagccagaccccttgtgatagagactgtgtgcaaagacagtgcttcccttaactccctggagaacctgaacagatgccaccattaggaagtgccttgcggctccattgactttgcaggagcagagccagcctgcaaggctgtttgtggaagatctgctgctcctgcagtctttatcacttccaagctgtgatgtgaacacaagcaacctgtgggctcaaggtccgtggctgctctgacaccttctgaataagcgatttcagtgcaaatggccttgccaagctgcctcgcagggctcttggaggatgtttcagttgataaaactgtttgaagacaggatccttggcactgtttaagaatatacactgctcagcttaaccatctcattgaaagtccctgtgtgtggaagtgaatagggagcgagtcacactagactataccacacacagtagactcctgcgtgaggctgcaggtattaaaatggtttctcttaaaaaaaaaaaaaaaaaaaaaaaaaaaaaaaaaaa

SEQ ID NO: 1017 - DNA, 845 bp, Homo sapiens
  misc_feature (845)..(845): n equals a,t,g, or c
aactagtggatcccccgggctgcaggaattcggcacgaatggatctgtgtggatggtgtgtgccctgggtgtgtatgtmtgtrtgtctgcacccactgcagcagtacccaagcctgccaagggcaccatttgcttgaagatgctttctggtgccaactgtgcctgccaaggacaggtgaccagacagcattagacaggctgtgacctgaacaggcacggccagagccaagggggctgctgcagctccttctccagctgtcactgctcccagcccttcctgccccctctcctggcacatcccccaaggccttcaggctgacccctggatttcagaacacccctcttcatcagaacgtatccagcctgggttccatgcccatcaacagcaagacaccagttcccctgcataaacaggtgctgaagtcaggaggactcaggcagacacactgtacacatcaccgcaagctctccttcagtcctcccaacgactwtaagtgaggtgttaatatgcctgttttacagataaggtaactgaggatcaagaagttaagtgatttgttcaaggttgtcactgcagcagttttgtggtttcctctctaagatggagagaagttacaccaggacttagtgcctgggaagcaaagaggtgaaattactcggccaggattgcacagctgacagtgatgataccgatggctgtgcttttagtagctgttaggtaccaggaactgtgcttggcccttgacacatataatttcacggaatcctcacagcagattaaaaaaaaaaaaaggtaccatattgtccccattttacagaccaccccttacaagagtgggatggtn

SEQ ID NO: 1018 - DNA, 1660 bp, Homo sapiens
acccacgcgtccgtatacatatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctsatattcttgagcctgttcgagtttccttttccaagcctcctgttctcccacccccamccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcaggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaactcgag

SEQ ID NO: 1019 - DNA, 1087 bp, Homo sapiens
gcccactggaaatgatcttgtttatgtgtttccttgtttactgtctgtcttcagtagaatggaagagccatcggtattttgtctttttttccccttgtccattcttatatcctcagcttctagaacattccctggaacacagcaagtgttcagtattgttcatggagtgacagatgtctcagccaagaaggtacaatcacagggaagaatgacttcaactggtcttgacttcaacctgcttccagcctggttcccttctcccacctccctacagcccacagaagatcttttccaaactggaagtctgtccaggtcattcttctgctctaaggctttcagtagctcccccttatccccaggaggaagtccaaatgccttaacaagtgtcaaggaacacttggtgagccctgctttccttgctagtcactcgtgcacagctgagtctttccccagagtggatgtcattcatgctgttcccattgcctggattcctgctcctctccaccccattcaactgataaactcgtggtttttttttttttttttttttttttgagackgagtctcgatctatcacccacgctggagygcagaggttgctgtgagctgaggtggtgctagtgccctccagcctggatgacagagtgagactcggtctcaataaataaataaataataaagaagaaaccaacccttttgaccccggggtctcagacttttagccaccacatcagcgagttatggtgtttgttatagcagctctgggaaactaatgcatgttttcagtgacattttagccccttctgaatggtctggatggctggttgacagctaagttcagacccgatgcaaaagcgcagtctatgtaggaatgtcccctgtggacagctgctgtgtagccaaggtgggttacatactaggaaagggccctgggggcccccacagggagctaactctattgacgggggacccaggtaacagatgcaggcatttgctgtgagtcacaagacactgatgtgtgtttgcttgcctgggcaacatagtgagaccccgtctctattaaaaaaaaaaaaaaaaaaaactcgag

SEQ ID NO: 1020 - DNA, 3335 bp, Homo sapiens
tcgacccacgcgtccgatatcactcagtgtttgtgttttcttctctttctagagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacggatcagtacggaaatcagattcaagcattttcaccaagttctttatcttctttggcaattgttggggttggacttgatagctcaaatttgaaaacaacctttcaggaaaacacacagagtataagtgtaagaggcatcaaatttattccaggtcctcctggaaataaggatctttgttttacttggcgtgagtttgtctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaaggggagagcatactcttcaggttaaagccatctataacaaaagtatcatagaaggacctataattaagttaatgattcttccagacccagaaaaacccgttcgtctcaatgttaaatatgacaaagatgcgtccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactaaaaaaaaaaaaaaaa

SEQ ID NO: 1021 - DNA, 573 bp, Homo sapiens
  misc_feature (560)..(560): n equals a,t,g, or c
  misc_feature (563)..(563): n equals a,t,g, or c
  misc_feature (566)..(567): n equals a,t,g, or c
  misc_feature (571)..(571): n equals a,t,g, or c
gatcaagttccttagttttgacaatcaggtcccaaactctttttcttgcctcatttattcattcaacaagtattttttgtgcactgaatatgtggccctcactaggcagatgctgcctattcttttgcctgttaactaatttaacctcttgtcatacctcccaaatcaccttatgctccagagaaacttgtgtatggtcacgtaccacataatgatgctttggtcaactacagatagttgatccagtaagattaccatggagctgaaaaattccaatggcctagtatttactgtgcttttaattattattttggaatgtactccttttacttataagaaacttagctgtaaaacagcctcagtcattttcttcatgaggtatttcagaaaatggcattgctatcataggagatgacagattcatgcattttattgcccctgaagactttccagtgggacaagatgtggaggtggaagacagtgatattgatgatcctgaccctgcataaatctagcttaatatgtgtgtttgtcttagttgctgacaaaaaaaaaaaaanaanaannaaanaa

SEQ ID NO: 1022 - DNA, 1495 bp, Homo sapiens
  misc_feature (723)..(723): n equals a,t,g, or c
  misc_feature (872)..(872): n equals a,t,g, or c
  misc_feature (994)..(994): n equals a,t,g, or c
  misc_feature (1008)..(1008): n equals a,t,g, or c
  misc_feature (1078)..(1078): n equals a,t,g, or c
  misc_feature (1106)..(1107): n equals a,t,g, or c
  misc_feature (1112)..(1112): n equals a,t,g, or c
  misc_feature (1115)..(1115): n equals a,t,g, or c
  misc_feature (1121)..(1121): n equals a,t,g, or c
  misc_feature (1123)..(1123): n equals a,t,g, or c
  misc_feature (1228)..(1228): n equals a,t,g, or c
  misc_feature (1285)..(1285): n equals a,t,g, or c
  misc_feature (1369)..(1369): n equals a,t,g, or c
  misc_feature (1451)..(1451): n equals a,t,g, or c
  misc_feature (1467)..(1467): n equals a,t,g, or c
tgtggaaaacagtaggaaagcaatgaaagaagctggtaagggaggcgtcgctgattccagagagctaaagccgatggtaggtggagatgaggaggtggccgccctccaagaatttcactttcacttcctctctctctctgtcttcactgactgcacttcttcaggagaagcttttgttatctgtatcacgcagacatgctgctctttctgtttgtgtgcttacccatcacttggatggcagaattcttgtcacaactgagaccaccttctataaaagtaagctgaaaggaacagcatcctcgtcagtgctcggcaggggcgggtaggggatgatggttttttccctaaggtaaaactgctgttgctcttgtttcctttttaactgtcagtgtttggctttcatcagamtgaacattttggtgttccacttgaactgacggtttgatttttatcattttggaaaggtgatcatagcaattcctttccaacttgctaaaattccatactccccccttttaaaarwatkgttstgcttmcattgctktmcwtttsccttgkctsmctttttcytcctgtkgsctgaarttktwcyttcyttktttcttaagstwtttttcagtagcaaacaaggctgttttcatcaatacccacattcccaytcrgkrrgrmmatytagtyttytcccagkttaaktgkgrgrkggrkgaaaatratktckggkangkggawatkawawakgkkwwatgkaaacacaaatatatytytytamattccactttaattkgggaaaaaaggcagctkaagtggagtgtwaagrarracctkgrrstgcttttcaacatgggatatggtcactatrgcatrggaaacangatgccttctatcawakatgggtctaattactycctaatttaaaacacgtatttttttaaatagcatgtttattttcaaatatdatataatggtcgsgcrtccttaaataattttaaacaangtgtccccgrgacngcatataatgttcaaawgtkagaggtaaggacttycctttctgtctycttaacacttwagtaaatrattngawttawagcaagtttgtccaactkgcnncctgnggnccgcananggmwgrggaagggcttttcmaacacaaattcgtaaactttattaaaacatgagattttttgcctttttttttttaagcccatcagctatccttaatgtattttanatgtggcccaagacaattcttcttccaggatggcctggggaagccaaaagattgganacccctgatttgtaggttttcaactttaaaatatatgctataaaataagttcatttaagtaggctaggcatggtggctcatgtntgtaatcctagcacttagggggcccgaggcagaaagattrmctgagctcagcagtttgagaccagcctgggccaaacggtgnaaccctgtttttactnaaatacccaaaaaaaaaaaaaaaaaaaa

SEQ ID NO: 1023 - DNA, 920 bp, Homo sapiens
cccccgggctgcaggaattcggcacgagctggagtccatgcccctaggatggggtgagggagtatcactctgtggggtttcacagcaccctggatcctgccttccagcccctgccaaggtaaacagtgctgcctgcctcctgtggggaatgcaggatggggcaatgccctggcagcagggtcttgcctcagctgatgcaactgtggctgctcctgtgtgcacagatcatgtgcctggaagccttcctgcagcagggcagtgtcagaaagtggaagagtggtgtgagcagcttccccggggaaagcctggctgagcaactgaccttgagcaagcactgcagatggcccttgttcctgccgggctcctccagctgggagctctcagcccctggtaaattctggcagtgaaagacacattagcacctccccctacaatgaggcacctatctagacaacttggctgtccgggcttaacctgcgtggcagggaaggacgcctgcccagccttagcctctacgcaatggtggaggcagggagggagagaaccacacagctcccctcatttcccagcagcccccatggagcctagtcaacagggtgtggtcacaggctaaatgagcaaagatgtgagctaatatactggtaggtgtcatgggggctttcagagctgggtaaggagggaaagagatggagatactggttccccactccttaacgtgccacctgccttccctgtcctttaccctccctcattctgctggacctgaggaaaatgcaagggaggctaggcctagtggctcatgcctgtcatcccaacactttgggagactgaggtgggagaatcacttgagcctaggagtttgagaccagcctagggaacatagtgagactttcgtctctacaaaaaaaaaaaaaaaaaaa

SEQ ID NO: 1024 - DNA, 1538 bp, Homo sapiens
  misc_feature (719)..(719): n equals a,t,g, or c
  misc_feature (920)..(920): n equals a,t,g, or c
  misc_feature (978)..(978): n equals a,t,g, or c
aattcggcacgagaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcatgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatnactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaacaaagaatgatatgtgagaagatggccaatccantgcagcttggttctacatattttagggaggcatgaggcatcaatcaaatacattgaangagtgtatggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagtgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaaaaaaaaaaaaaaaaa

SEQ ID NO: 1025 - DNA, 1117 bp, Homo sapiens
ggcacgaggcgcgatgcagcacaggctagaggctgcgcaasgcgggggcccgcccctgggaccctccgggccgggcggtttggccccttagcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttwaaatgactgccmgctggtgcrtgctcacacttggcccac

SEQ ID NO: 1026 - DNA, 952 bp, Homo sapiens
ggcacgagcctggcacatagaaggtgcccattaattggatgaacgaatgggggagttagagtcagtactagaaaaagcatgggattatacttttaagaggccaaatgaaaatttggggaatagccattttccaggaatttaaaaggagccattttttaaatgtcaataataatttattggttattattttttaagcacttattatgggtgcttattataggcatggtaaaagcacttcatccacattatttaaatctcagaatctatgagtttggtgagatcactgcagttttacagaggaaaaaacagggcagagagaacggtaatttcctcaagttctcactcttgtcacttaatagatctagaattccaacccagatctgatggtgaagtcagtataagcttcctggagaaaggagtagagttaaggtgggggatggggcttgaagacttgataggattagggttgggagtgtcaactcggagatccacagtcaggcggaaggaacccacaaaggcaggaatgcacacagcatgctcagaggagatggaacctgaaaatagagagaattagcaagtagtgcccattggatggagtaaagagccatacctagaaggttatcactgggtaaccatgataagagttttggcctggtgctgtggctcacgcctgtaatcccagcactttgggaggccaaggcaggaggatcacctgaggtcaggagttcgagaccagcctggccaacatgatgaaaccccatctgtactaaaactacgaaaattatctgggtgtggcggcaggcacctgtaatcccacctactcggaggtgacgcagggggaattgcttgaaccggggaggcagaggtggcagtgagccacgatggtgccactgcactctagcctgggcgacagagcgagatccgtctcaaaaaaaaaaaaaaaaaactcgag

SEQ ID NO: 1027 - DNA, 1267 bp, Homo sapiens
ggcacgagctcactctagctgctatgataaacaagaagaccagtgaggaagttttgaaactctcctctgcaagagaatggtggccagccaggcgtggtggttgtcgaatctgtggcacctgtgggaagtgggctcagcccagggactgcctttggatcccccagcattggcaccatacctaccctgggccctaaggtggccatgcttctctggatttgcttccctagcaggggctctagtgcttgcccactccctgcccacagcatggcctgggagcagctgagactgggggccagctcatcccgcgtcgattcctggaagtgttatcagtgcctgttatggaggctggacccatgagtggcagccttccctggcagctgggctgacctgtctgcttttccattgctcgctggttttgttcactgtagggcgtgaggggtgagtagctgctggcctccaagtccatagctactcatgttgtacgctgttcacagggacctctaaggatgtacatcatcacacattcacacacatgcaccaggatttgctttttttggcagcttttcccttcctggcttcctttttgagtggtggaagtaaaataaaaagcaactagggctgggcacagtggctcacgcctgtaatcccagtacttttagaggctgaggcgggcagattacttgaggtcaggagtttgagaccagcctggccaacatggtgaaaccccgtctctactaaaaatacaaaaattagctgggagtggtggtgcacccctgtagtcccagctactcgggaggctaaggcaggagaatcacttcaacctgggaggcggaggttgcagtgagctgagatcacaccacagcactccagcctgggtgacagagccagactgtgtctcaaaacaaacaaacaaacaacaacaacaacaaaaaactgggctctggtggttgggaggaggagggaaggaagcaagtaccagggtaagcaggatggatggatggctctcccccagaggggcggcagcacacagagttctggagtcagactcagtagagggccagttttgactccactgccaaccacctggctgactccaggcaggttacatcactgatgaaagcctcagtttccttgtctataaattgggggtacaagcgatgaaaagaggctcaacatcactaatcactagggaaatgcaaatgaaaatcataaggaggtaccactttgtacccttaaaaatagttactacaaaaaaaaaaaaaaaaaa

SEQ ID NO: 1028 - DNA, 1299 bp, Homo sapiens
  misc_feature (1079)..(1079): n equals a,t,g, or c
  misc_feature (1105)..(1105): n equals a,t,g, or c
  misc_feature (1164)..(1164): n equals a,t,g, or c
  misc_feature (1197)..(1197): n equals a,t,g, or c
gacagtttgcttatccattcataaattgatggacatttgggttgttttcactttttggctattataaataatgctgctatgaatactcaagtatgagattttgtgtgaacatgtttttagttctcttgtgtatactgaagagtttaattattggtcatgtgatgataactctaaatttaactttttgacgaactgtcaaactgttttccaaagtgactatactattttatattcccaccagcagtgaataaacattccaattttgccatactcaccaaccttgtacttgtccaagccatcatagtgggtataaaagtatttccttgtggttctggctatgccctaatgactgtgaggctgaacatcttttcaagtgtgaattggccatttatataccttctttggagaactgtcttttcaaaccctttgctcctttttacattgagttatccatcttttaattgttgggttgtatattgtttaatttgaaaatccatgttatgtataatatgtgtaattctaaaattgtttattcttaccaagttgccagctatcagaacactaatttgttgcattatttttcccctttaacattagtttgttctgcttcctttattaataattaataatgggctgggtgccgtgcctcacacctgtaatatcagcactttgggaggccgaggcagtggatcatttgaggtcaggaagttcgagaccagcctggccaacatggtgaaacctcgtctctactaaaaatacaaacattagctaggtgtggtggtgcatgcctgtaatcccagctacttgggaggcggaggcaggagaattgcttgagcctgggagacggaggttgcagtgagccgagatcatgccactgtactccagtcttggcgacagagtgagacccagtctcaaaaaatagtaataataatgtattagtttgtgctgctgctttatcaaataacttattcttataaaatacataagagggttgagtgtggtggctcacgcctgtaatcccagcactttgggaggctgaggagcatggatcacttgaggtcagaagttcgagaccagcntggccaacctggcaaaaccccatctntactaaaaatagaaaaaaattggccaggcatggtggcacgtgcctgtagtcccagctantcaggaggctgaagcaggagaattgcttgaatntgggaggcggaggttgcagtgagtcgagatagcactcactgcactccagcctgggtgacagagcaagactcaaaaaaaaaaaaaaaaaaaaaaaaaaaaaaa

SEQ ID NO: 1029 - DNA, 1074 bp, Homo sapiens
  misc_feature (1063)..(1063): n equals a,t,g, or c
  misc_feature (1067)..(1067): n equals a,t,g, or c
ggcacgagccaaattcagtagtaacagtaaattactaaggtgttttctctcttcattacagatacgtaattcacctctgggacctcaaccacgaagggacgtgggaaggaaaggggacgtatgtctattacacagactttgtcatggagctcactctcctgtccctggacctcatgcaccatattcacatgttggtaagtttcctcagaaggagctctaacagagggcaagcctttcagaatcaggaacagtaatggtttcttcattaaaaaatgaaactttagaaataagatgtggatggactacttaaagactaaaaatgaatgtggctgcaaaccctccctctttttgccactgggtgtaaggcagtgccatggaactgctttggctggtgcctaactcaggaggtgtttgctgtcctgggagacttagttaactctgctgaccaagtcaatagattattcttttagcatgaaattaaggagctgcctttccccatagtttctatggctttaaatatttagcaggtactttgtaggtggtaatgggaattcctgcagtgttagctacttcacagatttatacattttccatctttgtaattaaaaaaagtctttacacttaattcctacattcctactaccatcattgtttacattttactttggtatgttagacgttacggtgtcgtagatctgcytcattggktggcccttcagtgatctaataatggtgagaattaaaatagttggtgggcaatttawttaaattataagcctagcaagtagcattttaaaawtattgggctagacgtggcmcatttctaagtctactttttgaaagaaactttgaaaacatactttttaaagaaagtatgtaattcttttttttaaaaaagagcctcggctggacgcggtggctcatgcctgtaatcccagctactggggaggctgaggcagagaattgcttgaacctgggaaatggaggttgcagtgagctgagatcgcgccactgtactctatcctgggcgacagggtgacactccgtcccaaaaaaaaaaaanaaanactcgag

SEQ ID NO: 1030 - DNA, 565 bp, Homo sapiens
  misc_feature (10)..(10): n equals a,t,g, or c
  misc_feature (21)..(21): n equals a,t,g, or c
  misc_feature (538)..(538): n equals a,t,g, or c
tccccccggnctggcaggaanttcgscacgagcagaaagcaaatcagtggttttctggagtttgacatgggggtactaacaagggaactttttggggtggtgggaatgctgtatattttgattgtggggatggttacatggttggatgcatttgtcaaaacacacttaatggtaatgcaaaatgaatatattttattttatgtaaattatacctcaaagttgaatttttttaaaaagtttcttttaaaaagtaaagacatttgtggtgcttcttgtaaattttactgctgattatgaccttgtttctttagatttgactttccaagtttgaaaagaccagtttaaaaatgacttttgctgggcatggtggcatgtgcacgtagtcttacctactcaggaggctgacgcaggagggtcccttgagcccaggagttggaggctacagtgagctatgattatgccactgcactccagcttgggtgaaactgtgagaccctgtctctaaaaacaaaaaaaaaaaaaaaaaactcgagggggncccggtacccaattcgcccaaaatgga

SEQ ID NO: 1031 - DNA, 409 bp, Homo sapiens
  misc_feature (37)..(37): n equals a,t,g, or c
  misc_feature (322)..(322): n equals a,t,g, or c
cccaacacccttcccacttggcacccagaggggctgntgggtggaggcctgactccaggcctctcctgcccacaccctctgggctgagttccttcttttccttggacgcccagtgctggccttggaggacggtcagctggaggatggcggtgggggaggctgtctttgtaccactgcagcatcccccacttctccacggaagccccatcccaaagctgctgcctgggccccttgctgtaaagtgttaagggggcggctgagtttctcttaggacccagagccagggccctcaatttccatccttgcgggaggccttggcggnggcattgccagtgtctttccagagccaaaaccagggaccaaggggaagattcttgaaccttgcaaggttcaaggggttaacaaggga

SEQ ID NO: 1032 - DNA, 975 bp, Homo sapiens
  misc_feature (970)..(970): n equals a,t,g, or c
  misc_feature (973)..(973): n equals a,t,g, or c
gggtcgacccacgcgtcsgtgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattgactttcctcttgtccactagctttagggtttgggggccaaattytaccctgggattttkaaaaattcaaactgtgaacaccacaatgttatagagcatattaggtagtagccagcatgaagggatgttttcttcctgagaaacagtgtnaangg

SEQ ID NO: 1033 - DNA, 846 bp, Homo sapiens
gaattcggcacgagtctttctgtttttaatgctttattacatatgcctagttttgcttaagcttgtctaaattttatgacggaactataaaaaatgtatttcacttttacgtgacatgttattggtgaatcttgtgtttgtatgtttttttctttttgaaaggagagtgcatttaaaatgctgaattgaacaggacatcttgagagaatgttttaatttgagctcatgtatctgctgatcgattctaagtgcaggatattttctgtttgtcatagatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcaggtgactacttttctaatgtgttttcagagctgtgtatttaagattgagtttggctctgggagatagaaaactcaaaacagcagagtgctgtggtgtgcatgtttgtgtttcccccaaaattctaatcaccaatgtgatgttacgaggtagggtctttgggaggtgatcaggtcatgagggcagtgccctcagggatgtgatgaatgcccttatgagagaccccagagagctgcttgccacttctaccgtgggaggacaccacgagaaggcgccgtctgtgaaccagaaagcagaccctcaccagacaccaaatttgttggtaccttggtcatagacttcccagcctccagaactgttaaaaataaatttatactgtttataatctaaaaaaaaaaaaaaaaaactcga

SEQ ID NO: 1034 - DNA, 1082 bp, Homo sapiens
  misc_feature (265)..(265): n equals a,t,g, or c
  misc_feature (354)..(354): n equals a,t,g, or c
  misc_feature (1064)..(1064): n equals a,t,g, or c
  misc_feature (1081)..(1081): n equals a,t,g, or c
gccaagctctaatacgactcactatagggaaagctggtacgcctgcagktaccggttccgggaattcccgggtcgacccacgcgtccgcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacancttgggaatgccatggggtttgataatctgccagggacatgaagaggctcagcttcctgggaccatgactttggctcagctgatcctgnacatgggagaacaaccacatttttctttgtgtgtgcttctagcagctgttcgggaggaccktgacccaayagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatctyctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaataaaaaanaaaaaaaaaaaactcgng

SEQ ID NO: 1035 - DNA, 1363 bp, Homo sapiens
ggcacgagtggcataggggcctcaggtatgagggctggaagctctgggcaggtgggctgtgtggcatctccctcttcactagccctgccacttgtccctgagccaggtgctacctgatggttgagctgtatggggacctctgccctgtggcctttcctcccactgttatttctccttggtttcctgttttccagctgtgggttcccagaggcgtcatttggaccctgggtagtagttagggctgagctctggggttgtgtggttggagcggcgtgtgtcttagggctgtactggcaagtgggccaaagcagtctaaacaccctggctaggagccagaaaccggggctccgtgtccaacccgggaagcctgggaagctcctccccgtcaccttccagatgctgccgcctccatgtggggggtgttgctccccgctgggtctttgcccgagttctgggggaagccggatgtggaggaggacctgggtgggtgccagagcacttcatccttaagctcacctcacctaaatgttcccacccccacagccaccaccggcacaggcaggaccatgcttcaacttgccaagagtgtttccagggactggtccctctggttcaacgagtttggtggttctcagcaccaactgcttattggaatcatctgagtagatttcagaaaagaaactgtcaatgcctggccccagcccctgagagtctgctgttattggtctccagtggaacctgggccccagcatttttcaaagctccccaggtaatttgaatgtgcagtcagagttgaaagcagctgccatatccagtttgggtctccctgcctctcccatgtccctgggttgccccagaaattttttctcattcactgataattttaatgatcaatacagagtttgcaaaagtgaagacagacatgtcagaccaaacactggattcagtgttctgttccatgagactgttccatgagttcatagttattaaaaccagaacttaagcgggaaactatagcaaatgatagaaactgaattttctcctcagtttttaatttttaaaaacttttaaggctgggtgcagtggctcatgcgtgtaatcccagcactttgggaggctgaggtggccagatcatgaggtcaggagttgaaaaccagcctggccaacatggagaaaccccgtctctactaaaaattatctgggtgcggtggtgggtgcccataatcccagctactaaggagactgaggcaggagaatcgcttgaacccgggaggcagaggttgcagtgggccaagatcgtgccactgcactccagcctgggcgacagagagagactccgtttcaaaaaaaaaaaaaaaaaaaa

SEQ ID NO: 1036 - DNA, 1758 bp, Homo sapiens
gggacgagccctgcccacctcctgcagcctcctgcgccccgccgagctggcggatggagctgcgcacggggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaagcttctggaggcccttgcgaggcgtcaacgtcatgatcatgggtgcagggccrgcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtggtgggggagtgggtattacatgcattgctgaagagtcaaaaaaaaaaaaaaaaaactcga

SEQ ID NO: 1037 - DNA, 602 bp, Homo sapiens
  misc_feature (597)..(597): n equals a,t,g, or c
gggtcgacccacgcgtccgtcccaggccacaagacatttcctgctcggaaccttgtttactaattgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgaaaaaaaaaaaaaaaaaancccca

SEQ ID NO: 1038 - DNA, 2105 bp, Homo sapiens
ggcacgaggttttttagatacccagaagcttgttctgggagaagctagggtgggtcagagtagacctgatgggtaactcaggtaaagatgcttttcttttatctgaactacttaatgattgctttacttttactttttaaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtactatcctagtcaaaactctcctaatagtttttcctttgcaggaccaatcttataaagaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtatttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactccaaaaaaaaaaaaaaaaaaaaaa

SEQ ID NO: 1039 - DNA, 2912 bp, Homo sapiens
ggcacgagccactgtggcctttaatcagtccttctattcacttccgcttctcccacctttactccattgtgcttgcaaatccagtgcccctctggggcccttctagttggtgagtcagctcccatacctgctgcagcactttggtgatactctaagtggtatcgtttgttttatgcaagttttctctgctctgctttattcgttaatgcatttttatttgccatcttttacactagaaatgtatttaaataccttgttgtctcatgaccttctttctttttttcattgctctggcttagtcttttttgtttattttaaatctgtaactggtcttttctctggggtctgaagagagatgagaactgagagcatatgtgcactctgctctctggaactaggagcccaggcctcacctgctgtgcttgagtctttcctcgttatttctgttgagtgtctttttctccttctatactcaatgtttcttcagatcttagggaataaactgaacactgtgatatatatgaatagagtagatatttactaaataattatgatgtccccaaatagatacaaaccaagtaaattaaacaccagacttatttatgttgtctgagaaagtcatatttgaaagaaaatttaccccaaactgttcgttggaccatcccttattcttataaacaggtctttattcttataaactttattcttagaaaaacagtgtctgcttttctacccccacttttctatgtcacatttgatttggggaaaataaattatacaaaataccatattatcccatcctataaattactcccggaaaacaagtcatgtgtttagaagctgtgccattaagactgatttcttttgcatactttgtgttacaacacttgtcactattgcagttgttggtttacatgcctgacttcctcaaagaggtcctgagagtagagaatgtgtcttactcttgccttctcttagcctagtttggtatttgacaggaccagagaatagaagtgatagatacaatgataactactattgattgtgtttcttttgtttataggcactgtacatgccacttctacccacattatatctgattttaacatttttttctgagacaaatattatatccattttacaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttggtcttgaacagcctggctgaatatcacatcataggaacacagttgcaccggtgccttaggatgctgagagttctgtgaaagtgatctgaaaaattaaacacaaagatgccccatcagtacaaaatgtatgctgggattcattatatcatcatgttaattatttccttctttcttcttccctgttatgctaggatgaaaccaagtccacaaatctataacagtaattttagtagggattttcttcttccttatccaaaggaaaacgctttcaggaggtgtttactccctctccccattcaccctaacttgttcctgttaaagggcccatcatcttctgttgcctaggtaattctagtgcccactgattatctacgaatgataccttcgttgttcatactgcagcgcctctgccatgctaatgtgagataatggtttcttgaagagtgtttgtttccagcctttgcagctcattcaaacttgggagagctctggttgcagcagaaactgcaagcagctggccatatgcattttattgatttattgtattttgcgttacagttgtccactaggtataaggtgacccttagagaacatctatttatagtaactaggggttgggtttctggagttctatagcaaatggacttatttttacatgtgtattatactaattagaatacagaagattcctggttaaataggaaaatacacctaatacctttttaaatgtttttggaatattgtctgaaactattatatttaacaggcaatagccagccaggaattgcttttttctcccttcattttgtttttaaaccaatttaagaaaaattgatgttttttctcaaaatagatgttgttggatgcagcagaatttttacataaataagccattctagtgtcaaaggaagaattatagaaaaaaatattctgatatgaaaatgctatttcaatattcaagagtacaaataggaaaggtttcatattgttggatgttctgcctagcaaaatggttaagaacacaggaggcacactgcatgcttctgaatccaaccttgggcttagcagttgttgttacttgtattttgatagttccaatgcagacatgacaattaattgaggtgcccagtagttaatataaataaaagatgcaagattgtattctattgaacatggttcatggtggaaattaacctatgggagcagacaattcttggaaggccaggctccaggcttcattctttcccacagtataggtaatgcagatgctggagtaaagagatgttctggccgggcatggtggctcacgcctgtaatcccagcacttggggaggccgaggcaagtggatcacgaggtcaggagttcaagaccagcctggccaacatggtgaaaccccgtctctactaaaaatacaaaaattagccaggtgtggtggcgtgtacttgtagtcccagctactcgggaggctgaagcaggagaattgcttgaacctaggaggcagaggttgcagtgagccaagattgtgccactgcagttcagcctgggcaacagagtgagactctgtctcaaaaaaataaaaaaaaaaaaaaaa

SEQ ID NO: 1040 - DNA, 1369 bp, Homo sapiens
ggagccttggtggaattctgcatcatcatctccttttttttttttttttttttttttttttttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtgkstcactctgtggatttgcatttgagactgtccctggggctggtgtacaagtttttattggtaactgggcaattgggggctgaattctaggaggattgaggggcaggtgggcagragcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggrgccactcttcatactgcttacgctgtgaatcattgacaaagccgggaccaaaattt

SEQ ID NO: 1041 - DNA, 719 bp, Homo sapiens
gaattcggcacgaggagaaaggagggaaggcacagcgctgggcagagatgccagaaaacctagttctaatcttggccttgctgctgtcagtgtgtggccttaagcaagtcatttttctctcggcctcaatttactctaaaatgtgtaccctcatagctactaagaaagttgttgcaaaaactagaaatgatgcttactggtatttaattagtctcaaacacatagtaggcttttaacaattagtggctgtcattttcattattattaggcgcttcaatttttacatgttggcaatctcaaacataccattttcttttttttaaaacccttttttttktttttttttttgagacagaatctccagcctgggagacagagcaagaccgtgtctcagaaaaaagtggggccgggtgcagtggctcatgcctgtaatcccagcactttgggaggccagggcgggcggatcacaagatcaggagatcgagaccatcctggctaatgcggtgaaaacatgtctctactaaaaatacaaaaaattggctgggcttggtggtgggcgcctgtagtcccagctactcaggaggctgaggcaggagaatggcgtgagcccgggaggcggagcttgcagtgagcagaaattgcgccactgcactccagcctgggcaacagagcgagactctgtctccaaaaaaaaaaaaaaaaaaaaaaaaaaaactcga

SEQ ID NO: 1042 - DNA, 2753 bp, Homo sapiens
ggcacgaggggacatggaggtgggaggcccccactcccctgcagtcactaggtccaaccactccctccctgccctcagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccatgtgmactgacctgcacttccaggagaaacgggctggcgttttccacctccaggccaccagcggcccttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcrtagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccatgggctttggcttctctgccttccaggcggaagatgatgctgatgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcaccaaggaagggggtcttcatgcagccggtgcagagctggtccatccagaggggtgcctcgtgctgcagcggcgtacggcgtgggtagaaggtgaagtccacgcggtagttgagcaggcagctgagggaggccatgtagaggtcagagaagcgcacgaggcgccttgagaagtaggtggggttgtggaaggtgcggaagatgctgccgaactgcgcattgaacagggccttggtgatgcacctcagctcctgccgctctttcatccaggcagccagcacctgcctcgactccgcgtcctgataggtctgcatgcgctccagcagccccgtgagcgcctgctgccacgtcagcgagtgcatgtactgctccgtgttgatgatgcggatctcacgctccagctcggggatgatggcgcctgtgcgccagccgtgccgcagcatgagatccgccagatcactatagaggtggtccccgaagtagagcacgcgggggccacgccattccgtcaagcgtaagaagtcaaacaggtttccctgccgatagatcttgcccttttccaagcgggtgatccggtcccactgaagtgagcccttctcatcgagttttctgaaagcttgcgccggtcagtgaagaagctgggcttgtctgcctggacaatgaccacatcgaagagctggcgccaatcgggacccaccatgtgccgcatccccttgtctacgaagctgaaaggactgttggtgatgaggaacagctgtttcccatgggccaccaggcggctcaggacagcaaacgtctcatcccctctcaggatgtacttctccatgtcctgctcgatccactggtacatgaggcccttcacatgcacgtctcggatggcgtccgtcacgtccttgtagagatgtgcttggtcaaactccaggctgtggcccagaaagtagtccaccacacaggacagcagagccatctccggtagcgagaagatgtccatgaactgcttaatggagggacccttgccatagaagccactcatctggtatagtgggatgtgctgggtacccccatacagctcaatcacctcctcgtctggcacaggctggc

SEQ ID NO: 1043 - DNA, 990 bp, Homo sapiens
gaattcggcacgagaattttgaaagaagttctactgtggataaaaagctatgaaacagcatcacatactacagagaaaccttttgggaaaggaagagccaatagatatggcaaacatcattgttgtcttattttcagaaattgccgcagctaccccagccttcagcagccaccaccctgatccgtcagcagccagcaacataaaagcaaggttctctaccagccaaaagaagaaaactctctgaaggctcaggtgttttataaaatttttttagcaataaaatattttttaaagtatgtatattttttagatgtaatgctactgcatagttaatcagcyatattatagtgaaaatagaacttttgtatgtactgggagaccaaaacattcatgtgaataacttttttgcaatttttaacttatttcagtgatctgggcccaaacctgaaatatccgagcggtatatttctctctggccccaagttttgtgatattgttgtcctacattttawttgtacatatgktataaactccacactgtacttcygtkatttcatttaagctgtcagttatctttttagagatttagataaacagagacatgtttttattctttccattgctgcttattcctctgcgtaggttcatatttcagkccttttacttcaagagctctaaaaaaaatgtcttatagtgcagctctattggtaatcgattcctttagcttttggatgtttaaaaagtgctttctttaccttgccttaatttttgaatgatattttgctgagtaatattctgagttggtgattttctctgacactgcttttttttttttttttttttttttttgtcatttgacacagaatcttrcagtgagttgagatcgtgccactgaactccagcttgggggacagagcaagactccatctcaaaaaaaaaaaaaaaaaaaaaaaaaaaaaaaaaaaaaaaaaaaaaaaaaaaaaaactcga

SEQ ID NO: 1044 - DNA, 1274 bp, Homo sapiens
  misc_feature (1243)..(1243): n equals a,t,g, or c
  misc_feature (1270)..(1270): n equals a,t,g, or c
cctgccgttggcggcctgagtccgcagcgccctgckccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagckactgctgctgttactgcagcagtaaagagccaaggagcaataactgaacgtttaagaagcttcagtatgcatgatttaacaactatccaaggtgatgagcctgtgggacaaagaccataccaacctctaccagaagcmaaaaagaaaagtarccagcccccagtgaatcagcmggttatggaattccactgraagacggrgatgwgraaacagatkaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttcctgtaacaattgcttccaaatattgactactaaaggcagttctgcaagatgtactaaatatgtatattagaaattatagaaaatcatgttgtccgttttcaaattcatcaacagcctagagtgcctgagatataagatgaaacacaaatccacagtatacttgaaaggagcctttttacggttcaggataaatcagcctttgtgatgtactgtgtttacctccttttgtgttgtatctggtaattaaantagggcccagattcagcaagtgacatnacaa

SEQ ID NO: 1045 - DNA, 519 bp, Homo sapiens
  misc_feature (13)..(13): n equals a,t,g, or c
  misc_feature (24)..(24): n equals a,t,g, or c
  misc_feature (35)..(35): n equals a,t,g, or c
  misc_feature (44)..(44): n equals a,t,g, or c
accaaaagctggnagctcccaccncggttggccgnccgctctangaactagtggaatccccccggggctgcaggaattcggcacgaggttttgttttgtttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaaaaaaaaaaaaaaaaaaaaaaaaraaaaaaaarwaaaaaaaaactcgagggggggcccggtacccaat

SEQ ID NO: 1046 - DNA, 1052 bp, Homo sapiens
ttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttsctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagcaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttggaaaaaaaaaaaaaaaaa

SEQ ID NO: 1047 - DNA, 262 bp, Homo sapiens
  misc_feature (256)..(256): n equals a,t,g, or c
  misc_feature (262)..(262): n equals a,t,g, or c
ttgcaggtatacatccagatgcacagaatgtccatttgtcccttattggtgatgctaattttgatcacttgggtaagatgtccagtttctccagtgtatcgttattgtttttccttttgcaattagtgggtaatttgtgaggagaaactttgagaccttgtttgacaattctgttcctccatcaaatctacccctccctaggtttagcatcctttgacaatccttgttctgaataaatttttaactaagatgtttncccaan

SEQ ID NO: 1048 - DNA, 1508 bp, Homo sapiens
ctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggcaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaagggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggaaaaaaaaaaaaaaaaaaaaaaaaaaaaaactcga

SEQ ID NO: 1049 - DNA, 438 bp, Homo sapiens
ggcacgaggcaaatgccatatatgtttagaccagcctttctcaattgtggcacttttgccatttttggccagttaaattctgttgtgggggctgtcctgtgcattgcaggatgtttagcagcatctctggcctctacctactaaatgccagtgcaccctccctgcagttaaatgaccccaaatgtctccagacataggcaaatgttccccggagaacaaagtcatctttggttgaggaacaaaatgaacctatatttaagatggtctaaatgtttctgagatggtctaaacatttataagcttaacaattaacttgaaactcttcaggactagagaagctatttgtaaatttaaacatctgacgccttgaaacacctttatcataaagataactaaaccagtgttctttgtgaatggccaaaaaaaaaaaaaaaaaaa

SEQ ID NO: 1050 - DNA, 1134 bp, Homo sapiens
  misc_feature (1)..(1): n equals a,t,g, or c
natgcacaacccggacggaagtgcctctccgacagcagatccaggctcggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacctactgagtat

SEQ ID NO: 1051 - DNA, 452 bp, Homo sapiens
attgtgtagcattcaaaacctgctgaacactcaccctcaatgtatattctctgttctggcctgcttcaaggtcagttacactacttcctgggatgggcctttctctggcttaagcttggttgtccctggctttcccaaggatcacagcccaaaaggcacagtggggaaaatttatggcctattcgagaagagtgagcagcctaatcaagccaagccttgatttggggttctcacttcactggtattttccctctgtccctaattgggttttctatagttactagttttccaggcctccaagggagattctgaggcttgatgtgttctgactgtgtcttggctttgtgatgctgagtgccagaaatactctgtactataaaaactaccatcgttctttgaaacaacaaagaggaataaagaacttaattctggtgaaaaaaaaaaaaaaaaaa

SEQ ID NO: 1052 - DNA, 683 bp, Homo sapiens
aattcggcagaggcacttatcatgtacatatagcctgttttttagcattgttagacaaagtaggcatattcctttccatccaagaactcataacctagtaattgtagttggctgatagctcattgcccatacacaaggatctaacacaacctcttgaataaacatcccccttattcagaaatgccttttcctatttccatattgcaactttgcttacaaatttccaatctgtctttctgtttacagaagatatacaaaattccttttgtatgatctctttatatctcttgattttcttttgtgtttgctaccaaagggcctgcacatagtgagaagattgtgcatgatctgtgagctctaccacacctggaattagggatcaccaatatgagaaaaaaaattggaggtacaaataacattatcatatgtwattggcatataaattacagatgtwtctatgactaaaaaccctgtggatatwaaccmaatgcagataawtwtaataaaatwtwtaaaaatwtwatcmaataatgatagtgctattcaaatacttcaaatttgcacagtgatttatttcttaaaatatgttaacacatgtgagccaatacactgaggtcactggataaataaacagattcttgcaaaaaaaaaaaaaaaaaaactcgaggggggcccgtaccctt

SEQ ID NO: 1053 - DNA, 772 bp, Homo sapiens
gaattcggcacgagctttcctgagcctcagtttctccaacggtgggaggtggtagaaattgatatagtacttaccactgagggtaaaatgagatataacctgtgtaaatactgtacaccacagtcattcaatagtggcagcttaaaaaaattattctacgattacccttgcttcagtgattcttcttggtgttattgaagggtgagatctcggtggggatctcccaggtgtttccataatcccagcgatcaccccagggagaacctctctccttaggctgctagaggacatgtgccataggaccagataggagggaggggcagcggtgggaatgcgttttcagagctacctttggccaagccgtatccttgtggggacctattgcattgctgctgaagtgctgttcccatcagccctggcttcgtgtggccctgtctggcaagggggtgctcctacaaagtcatggcagcctggtgccaaaaccatcatcccataggacctgctgtagctttgccagaagcctggcccaaggggtggaggcccctggagctctgacccaccacgtggagggtgggaaatgccacagagcaggttctctagaagggatttgtcagaagctaaactggggtgccccctgggctcaggcctgcacagtttctccctgaccacccagctgggatggatatagagacaggtgtcatgttgcagaaagcctgccctaagaggccctactggtgttttcctttattaaaaaaaaaaaaaaaaaactcga

SEQ ID NO: 1054 - DNA, 1746 bp, Homo sapiens
ccacgcgtccgggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgggacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccgaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaaggaaaaaaaaaaaaaaa

SEQ ID NO: 1055 - DNA, 582 bp, Homo sapiens
ccacgcgtccgctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcttgtgctggtatcaggcatcatcttctcgctggccgaccgctccagctcctccaccatccggatggatgccctggccttcttgcaagggctgctgggcaccgaaccagctgaggccttccacccacacttgcctatcctcctgccacctgtgatggcctgtgtggctgaccctttctacaagattgcagcacgaggtcctggtggtgctgcaggagctggtgcgggccctgtggccgctgcacaggcctcggatgctggatcctgagccacccagatctgaataaaacagatgcttaccctggaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1056 - DNA, 1592 bp, Homo sapiens
cggatttgttgagtgaatgagaatagtcagtcaagactctggattgttgaattttaggtgctgctcattgtccctcttttatcttcagaaatctcgatgaaaatatacacatagaagacaaaaccgaagaaatattttattatttgttggggcttctctaatttttgtatagctttagtaagctgaattagatggcatggaaccgagaagtttccttctacctgaattgggtgggagagtgtcacacattcctcttggcctcactctggtttttgcctgctttcttatggttagggagactgcaggaggttttagcttcagagcaggagacttagaagaaatctcaagaaagagaacaaatgtattagggtctcttagagggacagagctaataggatatatataatcctattatatatatacacagacacacacacacatatatatatatacacatatatacatatatatacacacatacatgtatatacatatatatacacacatacacatgtatatacatgtatatacacacatatacatgtatatacatgtatatacacacatatacatatatatacatatatatacacacacatacatgtatatacatatatatatacacacatatatgagtttattaagtattaatttacatgatcacaaggtcccataatagagtgtctgcagctgagggcaaggagagccagtccaagtcccaaaattgaagaaattggagtccgacatttgagggctggaagcattcagcacaggagaaagatgtaggctgagaggctagtcctgtcttgccttttcacatttttctgcttgccttatgttcactggaagatgattaaattatgcacactagattaagtgcagatgtgccttccccagcccactgactcaaatgttaatctcttttggcaaaacccaacagacacacccaggattaatagtttgtgtgcttcagtccaatgaaattgacattcagtattaaccatcacaacaaacgtgcatttacattgcatagtgaatgtccttgaacttgttcagtccagtttcaggtgtcttatttcttgggggtagaataagaaaagcagagagaagtcttcttttcccttggagcactggttctcagatacttttattttctagcctcttatggggtaataataattaaaatggagaaaaataaaataatagtaaaatttgaaacaatgcaaaaaatgtaaaaacgaaattactgaaaaaagggcccccattcgccagaagtaggcaggtggctcccagaggtgggcagagcttaggctgaaggaggcgggctgagctgcacctggggtggagagggcctgagtccactcctagttaaggtctgtcaaacccatctgcaccgctcatctgccgcaggggaggctgtgagggggcagaagcagctcctctccctgagggctagccatctggagggagacctacagacctaatgtttatgctgcatgctggaatagaaggaatcgtgtggtgctgagggaacctgtcccctaacccagaccagaggaggtccggaattcgatatcaagcttatcgatacc

SEQ ID NO: 1057 - DNA, 819 bp, Homo sapiens
aattccgaacatatccctacaaggtaagacagatataggctgatgmgtmtttttmacctttctcatttgctgattttcacaggaagaagaattgtgtaacatttatttctaacagtaaatggcaaaacttatgtattaccagatactatgtctagtagtgttttgttggctcattcactcattcattcatttattcaacaaacattttttgattgccttttatgtgccaggccctgccatagatgctagggactcagcagtgagcacaacagataaagaattctgtcattgcggagtttacattttagtggcaggtgacagataataagctaaattaaataagcmaaatatacagtatgtttaatagcaataatttctatggcaaaaaataaagcaggaaagagtaataataagtgtttggaatgatggtcagatagttctgaatatcacctgtgcatcattcttttaagaggctgtgttgttttaagtgtattgatataataattatactgaaacattgtgggattcaattatttaaaaaaggtctatacactgtgaaagctgatacactcactaacagtggacgtggttaaatgttgacataaacaaaaaataaacgaaggagtagagtaatagatctaagacaagtttggggaaatctgtgaatcttaagcttttctttttttctgagacaggttcttgctctgtcacctaggctggagtgcattggcacgatcatggctcacttcagcctctacctctccaactcaagtaatccggaattcgatatcaagcttatcgataccgtcgacctcgagg

SEQ ID NO: 1058 - DNA, 418 bp, Homo sapiens
  misc_feature (396)..(396): n equals a,t,g, or c
aattccatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctcgcttgaactcggggaggcagaggttgcagtgagccgagattgcgccactgccttccaacctgggcgacagagcnagatcttgtctcaggaaaagga

SEQ ID NO: 1059 - DNA, 1002 bp, Homo sapiens
cgtattttcttgtaaatactagaatcttattatcaatttctctattttaaaaagcctgatgatattttggtcagtattaagttgaatctctagatcatttttgagagaaatggcttcttataaaactttaaagatgctgttttcctgtcttctcacttgcagtgtctctaatgagcaatatgctgtcatctttaacttttttcctctatatatatgttttttatctgattgctttaaatgtttctctttatcactggttttgagcaatttgattataatatatcttggagtaattttcttcatattttttgtacttgatatccatcgatcttcttgattctgtgtgtttataatattcatcaaattgaaaccattttggtgattatatcttcaaatataatcaaatgcaatcatattttgtctctccttctcctctgttagtcttcaaggactccaactatatctatgttaggctacttgcagttgttccatgcttattttttttttcatttttaaaaactattttttctccctatgtttcattttttctagcttctattgctacatcttcaagttcactaaccttttgttctgcaatgtctcatctaccattaatcctctcaaatgtatttttcatatcacacgttatagtttgcatctctaatagtttgatttgggcttttttatttcttccatgtctctgcttaacattttgaatgtatgaaatatatttaaaactgtattaatacatttgcctgctaattctacacctttgttaattctaggtcatatcaactgattgattttctttgcgtcattatgggccatctttttcttgttcatttcatgcctgatattttaaaatttaaaaccaaatattgtgaattttaccttgttttgtgttggatattttttgtatttctatcaacaatcatgagttttcttcttggatgcagttacagtcattggaaacaatttgatcctttcagacctggcctttgg

SEQ ID NO: 1060 - DNA, 657 bp, Homo sapiens
cgcggcacgagacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaaggtactatatacaatgttcatttctcttgagtttgcctctaacaatgtttttaaaataactccatgggtgtttttgtttttcagtgatatgtgctttttaaaagcmtatacaccctcggctgggttgcggtggctcacacctgtgggtccccagcactgtgggaggccgaggtgggatggatccccgaggtcgggagatcgagaccatcctggctaacatggtgaaaccccgttctactaaaaataccaaaaaattagccaggcatggtggcgggcacctgtggtcccagctgctcgggaggctgaggcaggagaatggcgtgaacccgggaggcggaggttgcagtgagccgagatcgcgccactgcactccagcctgggtgacagagagctccgtctcaaaaaaaaaaaaaaaaaaaaaa

SEQ ID NO: 1061 - DNA, 2458 bp, Homo sapiens
ggcacgagcgggatcccgttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctaggctacctggctcctgtatcctttgttgtggatttttagatcacagttgttctttaagactgaaatttttcaagcactttgaaagtctctttttaaagcattatttgttattagtattttctgttacatataaaaacaagccaaatttttaaacttattgcctactgcattacaggttatattctgtttccctttatgtttccagtggatcactttagtcctcgctttattgcttttcaccttccctgatgcttcagaatcatcatgttttgtcagcttcttaggtgacttatagtcttgtcacagcactcctaagttccattttagctctttgtgcagctcttgcctgtccacttgaacttcccctcagccaacttttttcatatgcattaaaagtatttctcagaaatgcaaattaaaacactactgaaatactatttcttacctcttatgttggtgaaatttaaaaagtgtggcaacctagtgctgggaagaatgcaagctggtacaacaaccgtgttggaggggaatttgacaagacctaacacagctacacttgtactcttttgacccagcagtcccacttctaggaatttaccctaaaatacacctccagcaatatgaaactacatatgcatgagttatttattttagtacttttttgtaatcacaaaatgttggaaataacctgaatgaccatacatagggaagcagtaaaatgaatttggtacatgcataaatggaatacactgtacctgtaagaaagaacaaggaagaccttgagaaactcatatgaaattatttccaaaatatattaagtgagaaaagtaaagtgcatacagatatctagagtgtctgtccctaaagtaagaaatagggactataaggaaatctacaaacgtctactcatttttgcaaaagatgtaaagaaagataagtcagaaaccaacaagactgtttacctacaggaaataaagcgaaatggggtataaaaatggagcaatgagagggggagttggagggacacttctctgagtacacttttgtatataactctgacccttagaaaaaacctgacctttcacctacccaatcagttaggatgtgggagaacccaaaatgaaatacgaactgtaaaaaatgaacctaaatgtattcaaatgaataaataactatgctgggggtatagggaagaaaagagcaacctaagtacctttagaaaatgattattttgactatatactgtaacgccaaaagcaaccaaaaatatatatatgaatgtactatagttgtatatttgtttcttctacaaacaggagcatggaccagcaattctgacactatttaatgtccatgctaggattgaacaaagtaaatattttctgggtaatgagagctagttttctcactgtcagagaaaaatgatacatatgaggaaagtgagaagactagaatgaaccctgtggcattgggttggaattagagggatcagtatgagtttattcactgtaggtggatgcacatagaaatatagatgtatgcacgtgtgttggtatacaattgtatgtttcttaatgctgcctgctgagaggtcctagaagcaatgatatctcagtagcaataaatgtacttagcactcatctcttggttttttaacaccattctccaataaaatgaacaaggacttttgggtatatggttgattccagggctaagaagggccaaccacaagataagcttggaatatctaatggttccagaaaataagtactcaaaaaattgtgaagacatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtatcacaagaaaaaaaaaaaaaaagaagtgggagagagagagagagagaactagtctcgagag

SEQ ID NO: 1062 - DNA, 854 bp, Homo sapiens
  misc_feature (831)..(831): n equals a,t,g, or c
  misc_feature (839)..(839): n equals a,t,g, or c
  misc_feature (844)..(844): n equals a,t,g, or c
  misc_feature (851)..(851): n equals a,t,g, or c
cgaaattactcctcactaaagttgaacaaaagctggagctcgcgcgcctgcaggtcgacactagtggatccaaagaattcggcacgagcgggatcccggcaaaatgcagattccccaaaatttttgtaaatacagatgacacttatgaagagctccatttaatcgtttataaggtaacaactgttttccttccagcgttaatgattgtgctgaagtggatctttcttgcatgtgtacacgagtgcatgtgcaaacctcttaaatgtttcttggaaaagatattggaagttctgattatggtaaaactcaaaatgggtgttcttccagcgtaataagtttattttcagctccttttaaacagttctgttattagtgaaagaggaactgtttaagattgtgatttataaacgtgtgaagtctcacgtgctctcaaaccaaaggctgtcagaggttggtgctgcctgttctcgaaatggctctggatgggggccgtagccacgtgtctgtgcatatgctgcttttgctctgattttaaagctgtaggcttgctaattccataaggatcgtattttgkttctgtcaggacatggtcttgtaaggatatgtactcaggttgtgtttctaattaaaggcagtttttgattcaagaaagaagacggagcatgtgcacgtgtttctcctctttcctgcctgaggctgtggagaagttttcatttataaaggctcagaaatgatgccgtgggggamcaggaaggagcggagaactagtctcgagagtacttctagagcggccgcgggcccatcgattttccacccgggtggggtaccagntaagtgtngaagnattcccntta

SEQ ID NO: 1063 - DNA, 2827 bp, Homo sapiens
ggcacgagccttcatcaattctgggaaattttatctattttcactttgaatatgtcccaggtgcattgtatctattttatgaccatgaaacttatattagatctagatgagacttattctatttgccatgtctcctaaacttttatttctatttctatttctttatatctctgtgaagagttttgatttagttttgtcttttaggtcagtactcttcatgtcagatctaatccactgtttttaccatcaattgcattttaaattataatgattatgtttcactttctataaaatattacagttatctttactaaggtataatttacataaatatataatgtatttagatatatttacatataaatacatacatatttacataaaattaatttcagtgacttcaagggtacaattcatcggatatttatatatttcctatacatataatatatattatacatatttcatgattatacatataatatagcacaatatgcaatatatgtaatacatatgtataatcatgcaatattatatatcataatatataatatattatatatgtgttatatattataaatatatatgtgtaatcatgcaaccaccaccacagtcattgaaaatatttgtatctgttcttctgggaatttttccccctaatcttctgtctcatctttttttatagtatcttgttgctttcacatatttacatttattttatgtattctatcatttaaaaatatttatgttataatgtgcatccagtaaatctataatctgaacctcctttttctttttgagacagagtatcactctgtcgcccaagctggagtgcagtggcgcgatctccctcacggcaacctccgcctcccgggttcaaagaaattctcctgtgtcagcctcaggagtagctgggacttcaggtgcatgccaccacatccggctaattttctttttgtatttttagtagagacggggtttcaccatggttaggctggcttcgaattcctgacgtcaggtgatcaacccgcctctgcctcctgaagtgctgagattacagacttgagccacggtgccccgccaatctgagcctcttatggtctacttatgctttaatttttttttcgtaaattaatctcatggttgcttctctccttgaatgttttgtacatatgtactgtgtctgcatatttttgcacattttcatctgtgacaattctgtatggcctttattgtaggtatgtccttcaagagaagattggcatttgcttttgctagataactcacaggtgcccaagaacacttaaaagtttgtattatgtaatgtttcacacataaacagaattttcatttatctatataagggaatgcatacatatatgcatatgtgtcatgtgtaagtaaaacaataaaataaatgcctcttcgataccgacagattaagaaacagaactttagatgaacactgatatggttaggcttcgtgtccccacccagatctcatattgaattgtaatccctataatccccataatccctatgtgtcaagggagagaccaggtggaggtagttgaatcatgggggtggtttcccccatgctgttctcatgatagtgagtgagttctcacgagatctgatggttttatatggggctctttccccttcactgggcacttcttcctcctgctgccttgtgaagaaagtgccttgctacccctttgctttccgcaatgattgtaagttttctgaggcctcctcagccatgcggaactgtgaatcaattaaacctttttcctttataaattacccagactcagcagctctctacagcagtgtgagaatggacaaatacaaccactttttacaataacttcttaggacctaactatccactctggtgttcagtttcctccccatttttttttttgtacctgaaaatatttcttttgaataaatcatgcatttctttatatattcagcagatatattttgaatactgactaggtgtcagacatgattctaagtgctaggaacacaaaagtgagcgaaacagacaaaacctcctgctcttagaaagtctccattttagtaggggcaagataacaattaaaaggaataagtaatgcatttagtataccaaatgggaatcaatgctacaggggaataaataaggaaaagagtatagagagtgtcggtatgggcagaaagtacaccttgaaatgggaattcgaggaaggcttcactgagaagaaagaattgaagaaggtgaccagtgaagttgtgtggaagctgggaccagtaaaaccaaatgccctgaagtgttagggtatagataaataaaagcaagggagtctgcttggctggagcagagtgatcatggtgagaggagctcagagctatacaagggtgtactatgtaggcactggaagaaatttggcttttactccaagtggaactggaagcctttggaatgcttccagaatagaagtgatgtcatctgacttatgttttaaatagatcaatctggatgttgtgttgagatagactggaattggtcaaagataaagcagggacaccccaggaggctattatagcaacctagatgacaaagggcagtggttttcatcagaacaatagcagtggaagtgacaggaagtggtcaggtcagattctggaagtatttttaaggtaaagaatacaggacttgttaatggattgtatgtgggtgtgaaatagaagagtcaagaatgactacattgttttggcctgaacaactgcaaggatagatttaatatgaactgagagagagagagagagagaactagtc

SEQ ID NO: 1064 - DNA, 1740 bp, Homo sapiens
ggcacgagcgggatcccgttccaaattcctccctcctgtcccctatatcattgctgtcatttatttgacttatacattagctgtaattattaatacgtcgttacaattaacattttgaacaaaatgttatatgttagattacttaaaaatacaaaaatagaagttttgattttacctttatttattctttttctaacgcttttcctttttattcctaatggttttttgtttgtttttgtttctttatatttttagtgactgaattaacttattagcaacaaggctaatggaaatcacttgagcctctctaagtctttctcctcccttgacacatttggaggactgagggaactaagtgatttctaatgtctttccagctctatttttcagtgattttagtttaggctttttagttctttcatttcttacaagatttgcataccaaattgttaattaaaaacaatccacattttatcctatagttgtctagaatgttcattgtcttctcagttctcttgctttttttccaatttgccatctgccagtttgctgacttggcaatatttccactatccatgtgccagctttgcaacctctcagcaaggctcgcagctccttctgcacgatttgagggtcttggcataaataggaccaggaaggcagagggaagccttccaaccactgcagtgcaattgctcccctataaaagccaagcagttcaggtccagcatcctcaggccgtgattgtagataaactctctgtgatttcattgaggagtatttgtatagatcagctgaaattcatggagatggaaaacattattaaacccggttatgtgacttcttgaagttacattgtgagttatgaaggctgcattcttttaaatgggttttggaatttagttgtgatgaacatttgaggatttagaaatagaaaaataaattgtgtaaacccttcgctttctgtctgcatgcgtgaagaccacatagatagcttgtttgcttttgctacagtctcattgacttctctgccctcgtcagtcttcctctccatgttttccccacttatctttcttacttcagtgcagaatttctttctttattttaatgtctatctagttttttattatttctatcagtgctttatagatttctcagcttagttttgccttggacaacttcttctctattcacaggtatcagctgggattgacaagggttagtttcttcgtggaaaaaaaaaatgggagctaaactgactgatggaagcagctgccactaatagactttggtttttgttttaatcttcatggaagggtttagtttgcaaattcttcctgcttggatatttaggagcctttcctaaggaagggaccagaattattttctttatgtaaaattttatatgtgtttaaaattctgtcctctgtgtgtgtatatgtgtagtacatatgggtataactggccttaggaaataggttcaagtgcttacacaatattatcagtctaatattttaaacatattatctcaagttatttgtttgagtatagtatactttgaagggttcctcagcttcacttttaacctattttttatttctatttcctctacagtagcattatcctatagttatcctgatatccatttaatttcagaaggactggatattactttagtcaagatgcagtctgatttaattttatttttaaaacaaacagcagtacttctagagcggccgc

SEQ ID NO: 1065 - DNA, 1672 bp, Homo sapiens
  misc_feature (62)..(62): n equals a,t,g, or c
agcaaaagctgcagctcgcgcgcctgcaggtcgacactagtggatccaaagaatttggcacnagttctctctctctctctcgcttcttccagatgttagtcttgctatctcttttggctagtggtggtctgccccttcttttagtgggggatgtattagcttcaaaatcttcaacagtgcttttccttcctggcgactcttctccagggtgctccatgatcactccactccctccatctaggatgtgccttaaagctgggtcctcaggggaacagacggtggttccactctcactgctgcttargtctaaatcttctaagtaaaggatcttgggctgatgcatgcttttgatgaatgttttctccctctcgagctttctacttgagtgaagctcattcatgtccaccccagagtccagactggtgtcattgctctgggttctcttgccctttttcaggtctataaaggagtgcctcacttgtgcaactggctttccatcaagagacacaaaccaggctctgggatgckgggagggctttcctttggacagctccaggagggtctgttctgaaattccttgaagttccgatgaaaatggagtcattacaacagcctcatttagtgttccaggaacagagacggattccagtaagctgcttgagtatcggctccaatctgaagcctgggatggcaggctctgttgaccttcaagtatgatatcctcttccctggcatctgggggctgtgcatgagaatgaattggcattttgggcaaggtctgcgtaaagttctctcgatttactggttccatcaattggccatagactaactgtccctttcttggcaaagtagctgacttagcagtatgtaattgttccggtgtggagaaaaggtcagatgtttgaaggatggcaatgggttggctgtaaatatgcataagctgttcaggaatatgggaacgcccatacgcctcctcattacctgtgagatacctcttttcatcttgagcatcacctagagatgaagatagattggtgktaatatgtttaggttgtttggaccctacattgggctccaaagactgtgttgggtttcttgagtaattattttgattgactgatagaaatgaaacatcttcattgkagattttaaaatcgtcccgagtttttaccatggaaactctttcttctgtttctgcctttgatggttcctttttctgaggactatatgaggagtttttggcattgaataactgcgacttgtcctcagcttttaatgcaactttaactgtactgatatgatttatgtgtgttgttgaagttgtctggtctctcttgaggacctcaagtttagtgatatttctttctcttttctgtggagtaccacacttgtccctagagtagaagagaaggcaaaaaatatttaaaagttatgacacaaatggttcatttattaaaaatcactcccaatctacatatcatacatgcaatgctattgtgagatatgtagattaaaaataaaaaaggatatattataagattaaatttatttctacaaataaacttttcaatgtacagaatatactgaaatgataccataacttgatagttttctgtgtttatagccattttcttacctgcaataacaaagtagtacagcaaaaaatccaaac

SEQ ID NO: 1066 - DNA, 2032 bp, Homo sapiens
ggcacgagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggaccccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaaaaaaaaaaaaaaaaaaaaaaaaaaaaaaaaaaaaaaaaaaaaaaaaaa

SEQ ID NO: 1067 - DNA, 2476 bp, Homo sapiens
aggtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaaaaaaaaaaaaaaa

SEQ ID NO: 1068 - DNA, 2680 bp, Homo sapiens
ggcacgagtcttacagcaagtacttaacaaacttagatttccataatcagatttatctcaaaccgcaaaaaaaagctgattttattatgttaaactgataggagatttttatgagagatgaaagtaagcgattttaactttttaatttttttaatttttgctctgtttctcacacttgaggcttttctgaaattcaccaaaagagttttggcagttgtggggaatttaccagaaccccccattattaaaacaattggtttcttatattaaaatcatcagacaggttttgtgtacacagacatttatgttaagccactggatagaactaaactgtgtgtaggaacctgttttctctaagaaaggactcctttgagttctgtaggatatgtgcttaaaggttttctgtgtcaagctattttatgaaataaaattttacaaacaatgaagcttcattttcacacgttgtatttgtttaatgcagacttggcctatacgagtttttgaaattaagggttttttccgtaaaactagcttaggagtttaatgagtcactgtgtctctcacctctgtaggatgagcacagagatcacatttgagaagcaggtgtgggtgttttctgctggtcacgtctcctctgcctctcctctggctcagcagttacttttcctcagtcatgggggctgcattcagctgcgatgccagcattagggccaagctctcccgcttctgtgacgttttattacacgtactctttatcagtagtagctgccattccctgagtgttccttccaccgtgcactgagaagggctgaggatttccgaacatcaacctcctctaaccctctgtatgggaattagatttttatcatcctgactgttggggctttctagagctcaggcaacttgcccctgggcgggatggagcctgcctggggggagtgtgaatgaggcttctgttgtctgtggcttggctctctgtggttggaaacttcagaagcagtagattccaggtgcaacatttggtgcccggacaagttgtaaaacctgaccttggggagggccttcactggcagccagtgtccacccgtgagcccggtgagcacagacgttagagccagggccggcgggctcagaggttggagccggggaccagtgggctcagaggtcggagccggggaccagtgggctcagaggtcggagccatgtccctgccgtgaagctctgagggttggtggtgacatcggggcgattgtggcatcgcgattgtggtgtcttggctgcctttggccggcgctgccactgccctggtttcatgacgtaggcaccacatggtcctgtgttgtctcacttacggctccacttctggcttttttctacttgctcacccttgagataaacttctatttcattttcatttcggtttatatgtgggttttcttccaggtctgatgttaagcctataatattgcaatgtgatgttttgaagttaaggtgtaatagagccagtgaaccaagggttcacaccccagtgaaatacaaatattcagaattgagccactgtgttgccatactgattatgtaatgtgtgattaacaagtataatgtgtcactttcaacatcagtttcatgccaaagttgcattttattagattatttgggagttcactttgggcccaaaggctcgtgtctacataataataacttatgatttttctttttgtctttgttttattttttgttttgtgttttttgctttctagaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatagttgagttttttttctcttctctactttgtgaatcatatcaggtacctgtttttcctgtttcgattttcttttctgtgatagaagcagtcgtcagttcttggtattactaagtgttaaaagcatcagtcaggccgggtgcggtggctcacgcctgtaatcctggcactttgggagaccgaggcaggcggatcacaacgtcaggagatcgagagcatcctggctaacacggtgaaaccccatctctattaaaaatacaaaaaattagccgggcgtggtggcgggcgcctgtagtcccagctactctggaggctgaggcaagagaatggcatgaacctgggaggcagagcttgcagtgagctgagatcgcaccactgcactgcagcctgggcgacagagcgagactccagctcaaaataaaaaaaaaaaaaaaa

SEQ ID NO: 1069 - DNA, 866 bp, Homo sapiens
gctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctcaaaaaaaaaaaaaaaaaa

SEQ ID NO: 1070 - DNA, 893 bp, Homo sapiens
ggcacgagattaagctgagttgtagaggatgagtaggattgaagaaggtggggaaaggtgtttctagaagagggaccaagctcagagtggtgaggaaaggagaagtgcagcaaaaaacagacgcaaacaatgttactgcattggctacttcaaaatgagctgcaaagtgcagtggccagttgcttggtaagcatttcacttggcaaggaggactttcttcagacagggtgcaaggtgaaatcacacgttggagtaatccacagaagggagaaaggaggagcgatttatctgcccaactccctggtgcttcccacttcccactggataaggttatcctataggaaccgacatagaggtttcatcctctggaccttgatgtctacttgggaagccagatgccatggcccatgtgtgatgtttgattttaatcagaaatagaggggtgactcagagagacagcctcaacatgtgggtgtgaagaccatgcattcctaggactacagctttgacgtcaggcagctctggccacaaaaaagggctctgatagagggcagtggtggtttgggaggcaggcagcccttttggaaataaagagtcaattaaaagaatctaaggaaacatacacaatttgtgtccaacacggtccaccccctgtgccctctcattatgttcagctcccagatgataatttgggcttcagcttgttctgtgcaaacggtgacattcctagtttcttacttattccttaagaagggagctacagatcctgccagtcacagggtccccttcaagatggtagtcaagagtgtttttctctcgattgaagccgggagttggagaacagcctgggtaatagggcaagaccttgtctctacaaaaaaaaaaaaaaaaaa

SEQ ID NO: 1071 - DNA, 2466 bp, Homo sapiens
agtccattctcctggtgtctctggatctgctccccacctccatcctcctggtgtctctgtggatctgctccccacctccatcctcctgggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggttttaagctctgcagcgtcactccctggctctgaactcccctcctccaggcctgagggttcccagggaggagaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccctagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcaccttcaaaaaaaaaaaaaaaaaa

SEQ ID NO: 1072 - DNA, 1226 bp, Homo sapiens
ggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttrtcagagatttaggagaggtacaatgtcaagggatacaakacaggcawtttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggcccctgagattctaaaccctactcgtgataattagcccacctttgaatcatcataatcttttattagattatggtgaaatgcccataatgtagttagatggcaacataaaaagtaaatactttattgagtgagataacatcatatggaggcttaaagtatttcttctatatatcatatacaatatctggcacaaactaaaaaaaaaaactcgag

SEQ ID NO: 1073 - DNA, 672 bp, Homo sapiens
  misc_feature (1)..(1): n equals a,t,g, or c
  misc_feature (378)..(378): n equals a,t,g, or c
  misc_feature (416)..(416): n equals a,t,g, or c
  misc_feature (421)..(421): n equals a,t,g, or c
  misc_feature (425)..(425): n equals a,t,g, or c
  misc_feature (437)..(437): n equals a,t,g, or c
  misc_feature (451)..(451): n equals a,t,g, or c
  misc_feature (461)..(461): n equals a,t,g, or c
  misc_feature (464)..(464): n equals a,t,g, or c
  misc_feature (470)..(470): n equals a,t,g, or c
  misc_feature (481)..(481): n equals a,t,g, or c
  misc_feature (489)..(489): n equals a,t,g, or c
  misc_feature (494)..(494): n equals a,t,g, or c
  misc_feature (497)..(497): n equals a,t,g, or c
  misc_feature (511)..(511): n equals a,t,g, or c
  misc_feature (520)..(521): n equals a,t,g, or c
  misc_feature (523)..(523): n equals a,t,g, or c
  misc_feature (528)..(529): n equals a,t,g, or c
  misc_feature (544)..(545): n equals a,t,g, or c
  misc_feature (549)..(550): n equals a,t,g, or c
  misc_feature (554)..(554): n equals a,t,g, or c
  misc_feature (557)..(557): n equals a,t,g, or c
  misc_feature (570)..(570): n equals a,t,g, or c
  misc_feature (572)..(572): n equals a,t,g, or c
  misc_feature (576)..(576): n equals a,t,g, or c
  misc_feature (589)..(589): n equals a,t,g, or c
ngttcaagcaaataattctattgtgaagatgcttggccgggatctgtgcctcctgccccagactccagccagtactgcccaggggagagtctgagtcgttctcctaatgagagcttcccaggagatctccgcctagcaagtgcaaaaggcattgactggcctgtgggacagttaagaaacggtagcagttactccctttccaccttcacggcccaggagttcgatagcagatgaagacggtgagtcttcttctaaccctatggttctcccaaactttctcctttaacttattttttgccccacctcattctcttcttcagagttctatttttttctctgtgtcttctataactactgtacaccctatcctggtctttntttttgcattctttggggcttggttgccgcgtctgtantcccngctnctcaggaggtcngggcagggggatcncttgagcccnggnttttgnggctgcagtgngcttcggntcgcnccnctgtgctccctccngtctgggcnncnagtgnnccctgtctcttgacnncggnngggnttnatggcctttgctnancgtnggccgctttgtcntgctttccccccgggctctctgggcttcctggcgtccttgcccttttgtttgttcttcctttcccgccccgccccggctcggt

SEQ ID NO: 1074 - DNA, 571 bp, Homo sapiens
gaattcggcacgagtcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtcttaaataaaatgtataatacccaaaaaaaaaaaaaaaaaaaaaaaaaaaa

SEQ ID NO: 1075 - DNA, 2394 bp, Homo sapiens
  misc_feature (1783)..(1783): n equals a,t,g, or c
ggcacgagcactcctgcacttccccacccccacgaccgaacctggcttcgctaacgccctcccagctccctcgggcctgacttccggtttcctcgcgcgtccctggcgccgagccgcggacagcagccccttttccggctgagagctcatccacacttccaatcactttccggagtgcttcccctccctccggcccgtgctggtcccgacggcgggcctgggtctcgcgcgcgtattgctgggtaacgggccttctcycgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaatcgaaactcggcggccttgggggcggccctacgtagcctggcttctggttgtcatggatgcactggtagaagatgatatctgtattctgaatcatgaaaaagcccataagagagatacagtgactccagtttcaatatattcaggagatgaatctgttgcttcccattttgctcttgtcactgcatatgaagacatcaaaaaacgacttaaggattcagagaaagagaactctttgttaaagaagagaataagatttttggaagaaaagctaatagctcgatttgaagaagaaacaagttccgtgggacgagaacaagtaaataaggcctatcatgcatatcgagaggtttgcattgatagagataatttgaagagcaaactggacaaaatgaataaagacaactctgaatctttgaaagtattgaatgagcagctacaatctaaagaagtagaactcctccagctgaggacagaggtggaaactcagcaggtgatgaggaatttaaatccaccttcatcaaactgggaggtggaaaagttgagctgtgacctgaagatccatggtttggaacaagagctggaactgatgaggaaagaatgtagcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaanggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttataatgcgtaaagatattgaaaatataatgaaataaaagcatcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattggggaaaaaaaaaaaaaaaaactcga

SEQ ID NO: 1076 - DNA, 1705 bp, Homo sapiens
  misc_feature (779)..(779): n equals a,t,g, or c
gaattcggcacagctttacagtacataggaatttgagaaccacttcacaggaagagggaaacagcccaatatttatttatgtatacacataatcccaagtgtgtgctggggccaccaggcttacctgggggaacaaggactgtcgtgcatgtgagtgacgacattaatagcatttacatactgtacagatgcaacctttgatgatacatatatttgataaaaatgagaaaacagatttgttgtagagtacctgtccacttttatagcatgagaacagtacaatcaactatttattttgcagttactcatttcagtgattgagaatttctgtgctgtgcagagagacggcctgtaattggtctcatcatccacttgattctaacatgatctctgcccaaagttccatttcttgggctttgatatttataatggcgcctgctcttcatcttgtcttacgctttccgagcaagttcaaaccagaaagaaaaggtgaggctagaagcccaaagtgagtgagtgtgaggaccacaaggaagcccaccactccacagtagatgatcaaaaccacatcctcacgtgggaggtagcacttgggagagggtgtagtctgtgggcgtgatgctaccctggaaaggaraagggaaagttatgctgagagcaccaggcacaggttgaacaccgcagtcttagaaacagcagagggaagactgcyttctcaggtccccctcaggtgaggcagggaacgggccctcctcacctgagaccaagggggcccagcnttctccctgcacagctcacccccgaccagcccaggctccagcaggagagacaagtaaggcccaagtgtgcctgagtggaaaatgtctgggacactgacctgtcaaaactggcccctggctcactgggttcccatcaaatatagtgggggatccataacagagttsagagaggcaccgtggagttccagggtcatcggtcagcgaggaacaaggagggaaaggtgtcttcctgccccttgatgctcaamtaagcatctgttccctagaaatacatgtgtccaggtcgtctccatgggcttttctttgcagatacttttatgtggaacaacagtggcaaatgttttcatttactttgaatttgaaaatgttagggtttcctccacctttttatgaagtaaaagamcctgtcgtaccagcatcatgagctggatgcaggagcccatggctgaaaggagttaaaacgcccagtggtcattaagtgaaacatcttttatcaacctgcaaaagctgccagcgttctctgccaggtcaaatgggcatgtttagaaaataagagaagatggctgagtatagctaatgaataaatggttgtttctttagaaaattaaacacacacagagtgtaagaggagaggatacggccctccctgaaggataaagtccmcctggacggtgccctgccctcgcttctcacattaactgcccaggaatgtcatgctgattggttcccggaagggtgtttggcaaggggcagtgtatggagctacgtgtagaaggagagaaatttgtgtgtggcttttgtaaattttgaccgattgcagcaattaaatagttgattactgtgttgatttaaatacttatgaaagctttcagacaaaaataaactttcacgttaccatgaaaaaaaaaaaaaaaaaaaaactcgag

SEQ ID NO: 1077 - DNA, 711 bp, Homo sapiens
aagctcgaaattaaccctcactaaagggaacaaaagctggagctcgcgcgcctgcaggtcgacactagtggatccaaagaattcggcacgagaagcaagattgtgcagggcaaggaactcagcaaggatgtggcagggaaaggagaccagctaggtcagctattcttcagcctgattccatgcgaaccctaagcatcaattgcatctcagagctggttccactttgaggcgagggtctggccttccatattctcatgttagtcattgactatgggctgcttgtgtttgtcattgactatgggctgccttgtctatgggctgcttcaggggtggggaaagaaaccttattggcaagtagctcccattcagctagagccaattttccatagacgaagtggctgtgagccattagcaatcatcattcacagcctctgggggatggggacacctgctgtgaaaagaatctgggcaaggcaccaacggtatccaccacaccatgatggatacaatctggtttcaaagcgggaaggaaggcaggatttgggattaactctagtttatagaccggagaactgaagtcgagagatcaggcaacttgcccaaggtcaaactgctagcaggcattagagaagaaatggaggaggcaaatttcttgcctcttgcatgaggttattcatatgatcatagttttctaaaaaaaaaaaaaaaaaa

SEQ ID NO: 1078 - DNA, 2072 bp, Homo sapiens
ctcgtgccggagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtaggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtccaatccctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggtccttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcagggccctaggtccagccctacagaaaacgcagcaaggagagaccctagggagtagtgagtatagatgagggaagggactcagggaaggaatggcctgctgagtagtcagcggtgcttaggaaggcttcctggaagaggtatcccttgagcaaggcctaggatgaatagaattcatctgagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatacctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacaaaaaaaaaaaaaaaaaa

SEQ ID NO: 1079 - DNA, 1221 bp, Homo sapiens
  misc_feature (697)..(697): n equals a,t,g, or c
  misc_feature (700)..(701): n equals a,t,g, or c
  misc_feature (712)..(712): n equals a,t,g, or c
  misc_feature (720)..(720): n equals a,t,g, or c
  misc_feature (722)..(722): n equals a,t,g, or c
  misc_feature (742)..(742): n equals a,t,g, or c
cactagtggatccaaagaattcggcacgaggagagacttgcatagatcagggagtatgtgaaaataaatgtcagttgccagagaaagaatagatcaaacagtttatttgaatttctgatgagtttggtgaggaagtgtatagcacttaacatttggaaggcagacaaaaggttttgttgttggtgttatgttccttttgaattttagatacataatgcgattttttttctggccaatgctccaggcaaaattgatgtctttccactttctaaaacccatcatatttatgaactctctgatactctgtctgaaacagtcgtgctcctgtgaggttgaaatatctctcctgcctctatcacagcagacgcacagaactgatctgggattttctcactcaggatcccaaaatgagccctttctcaatcttgacaaacgtgcagcagaagcccattgtgcagttatggttctgtgcctgctgggcagggatttaaaggccaggagaagcagggaaggccctgctctctgctccagccaggtggtaatatgcattctcaaactagctaggaaaaggttctagattcctttgaatctattgctgaatcccactgattagcttttcccactgacagacattcaaatctttgtttttggagcttcctctgcagacttggtgtaaatttcaaaaaaagaaaacaangcnntgaagcttaanacaggcananacagttggcttcctacctangcatgcttcaaactcactatatgacttggtaaattctgttactttaatgcatgcttgttttcacatgtgtaaaatgagagagtatcagactagatcatggatttgtttcccctctttttccccttctctctcgaagagtagaaccctttaaattaaatcttttataaaagttaagtggccgggagctgtggcccatgcctgtaatcccagcactttaggaggccgaagcgggtggatcacctgaggtcgggagttcaagaccagcctgaccaacatggagaaaccctgtctttactaaaaatacaaaaaattaggcaggcatggcggtgcatgcctgtaatcccagctactcgggaggctgaggtaggagaatcgcttgaacctgggaggcagaggttgcggtgagccgagatcatgtccattgcactccagcctgggcaacaagaacaaaaatccgtctcaaaaaaaaaaaaaaaaaa

SEQ ID NO: 1080 - DNA, 1293 bp, Homo sapiens
  misc_feature (1)..(1): n equals a,t,g, or c
  misc_feature (7)..(8): n equals a,t,g, or c
  misc_feature (25)..(25): n equals a,t,g, or c
  misc_feature (396)..(396): n equals a,t,g, or c
  misc_feature (1271)..(1271): n equals a,t,g, or c
naaggannccaaaccgcagaaagtnacccgtcacgtaaagggaacaaaagcctggaggtagcgcgcctgcaggtcgacactagtggatccaaagaattcggcacgagaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgnaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggtttaaaaaaaaaaaaaargtgaggacatctgggtctcatttgcttctgctaggttaaacttttacttgacaacaaggattcctgctgaagtctgaaccttactgtgtaaccctcagtttccactattaaagagtatcttttgacgtctgcttggaaaatgaatagtatactggtaactcagtctccagtcacctctgtgtctcttaagcaagagattctaaaagattgggaaaacatatcctccaamacctgcctttgcctaaccattatttttcaccagattacttcttaagagagggaggtgattctgaagaaggcttctatctcaaaaagcactgggcttccttattcatctgttcttgttgtttttgacggagttaaaaaagtttgtgtgcaatacaatataaatgatgtgaaggacactcttaaaaaaaaaaaaaaaaaaaaaaatngctgcggccgacaagggaattc

SEQ ID NO: 1081 - DNA, 4313 bp, Homo sapiens
  misc_feature (1126)..(1126): n equals a,t,g, or c
  misc_feature (4015)..(4015): n equals a,t,g, or c
caagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttcctgcacacctgtsgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgnaaggwgagatcaacaatgtgcagtgggcatcaactcagcccgaaytgtcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaakgywkkttttcatgtctcgtccatgtccatgttcgtgttagcactwacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcagtgtctttctgttatgtgaatgagttccatggaggggcatatgtgtgattccaccgttagatgagcccttggggcaggcagtttgggatgtgctcttgggggaaagttggctgtttccttgcgctctgctcctacccgaagtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcntctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaattaaattggccgggcgtgaa

SEQ ID NO: 1082 - DNA, 762 bp, Homo sapiens
  misc_feature (288)..(288): n equals a,t,g, or c
  misc_feature (364)..(365): n equals a,t,g, or c
  misc_feature (387)..(387): n equals a,t,g, or c
  misc_feature (395)..(395): n equals a,t,g, or c
  misc_feature (421)..(421): n equals a,t,g, or c
  misc_feature (430)..(430): n equals a,t,g, or c
  misc_feature (434)..(434): n equals a,t,g, or c
ggcacgagcgaagatcaaagtgttgacaggcatgggttcttctgagacatccctccttggcttgcaattggtcaccttcttgcttcttcacatggtcctccttctgtgtgtgactgtgtccaaatttcctttctgtaaggacacagccatattggattaggcccaccctattgacctcatcttaacttatttactcctttaaaaaccctgactccttatacagtcacactccgaggtactgggggattaggatttcaatgtatgaattttgggaggtgagaaggacanaatttcagccaataccagttaaatggatttagtaattcaaacacaggggattggaatacggcagatttttaagggnntgggaattgaagccagaatttnggaagggntttagaactgatgggagggcaggtgnctgggtccngggngattttggaaaaagatttttcaggccaggtgaggtggctgattcctgtaatcccagcacttttggagrccgaggctggcagatcacttgtaggccaggagtttgagaccagtctgggaaacatggcaaaaccctgtctctacaaaaattacaaaatatcagccagaagtggtggcttgtgcctgtaggcccagctcctctggaggctgaggtgggaggatcactggagcctgggaagtcaagtctgcagtgagcaaagatctgtgcctctgcaccccaagctggacaacagagcaagaccctgtctccagaaaaaaaaaaaaaaaaaa

SEQ ID NO: 1083 - DNA, 1164 bp, Homo sapiens
  misc_feature (582)..(582): n equals a,t,g, or c
  misc_feature (592)..(592): n equals a,t,g, or c
ggcacgagcttgtgtgtcaccagcctcctgatctgccagggtctgctctgggttggcactgaccagggtgtcatcgtcctgctgcccgtgcctcggctggaaggcatccccaagatcacagggaaaggcatggtctcactcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctcggcgggcagggctaccgcaactttggcagcgctctgggcacantgggaagcangccccgtgtggggagacggacagcaccctcctcatctggcagtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttggaaaaaaaaaaaaaaaaaa

SEQ ID NO: 1084 - DNA, 753 bp, Homo sapiens
  misc_feature (337)..(337): n equals a,t,g, or c
  misc_feature (649)..(649): n equals a,t,g, or c
  misc_feature (720)..(720): n equals a,t,g, or c
  misc_feature (750)..(750): n equals a,t,g, or c
ggcacaggttcttttgccagtcatgacagaaccatgcaagatattgtttacaaattggtaccaggcctccaagaaggtgagtgtctgactgtcttgctgatccctgaggtcccagcctggcctctgcagcccctgctctcctggaagtttggttctcggatgggaggcccctttccttttggccgaatcaccgtcttctcatccctgctctcagcccaacttcatctccttggctggtctcttctttcgtctaagatgcgtakacatctttttaccccttatgtgtattcattcagcaagtatggatcgcatgtttagcacatgggamccccagggntcaacgcagctcctgcccctcccaggaccctgccttsttcctgggccccacctcctgtcccaggcctgcctcccctcatcccacagcgccagcttccccacaacagaggagcagcacgttggcatagcgggtagctggtgtttctagaaaaacttcaccataaagtcaaatttcatttagaattaaaagaaataccaagtagtacaaataccctgaaagtggaaatcggttgcttggggatcgctcagctgaaagctcccccagctcccgacactctcacggtggttggccctccgctggcgaaccggcaangaagcccaaggaagggggccaggttcagcgcccaggttgggcttgtccctggttattcctgctccatccanaacctttccaaaaggcagaatagaaaaacntga

SEQ ID NO: 1085 - DNA, 1978 bp, Homo sapiens
  misc_feature (1978)..(1978): n equals a,t,g, or c
tctacctgtgtaccacggcctgggatggaccctgcagctgtggccctcctggcactatccctaccctgtgccctggtgggtgtgcagtgggaacaggcaccctggggtccttggaggctcagcctcctcagccctcacccccgagaccccatcgtggcgcctgtgtccactcagggattatcccaagcctggccagaggtcgggaggggacagagggagccacataggagcctctaccagcccctttcttaccacagggtagggggcgcttccctcccacagggtctcaggcttgtgggctccccccagctgcacaggccccagagggcacttctgacccttctctttggggtctgccctggggggctccaggccacttgctccaccccatccctcttctggagcctcccagcacctcagttccgactgtggggaaaacagaaccctaggaagcaacctcacggctgtgggcaggggagggcggccgggagccccagctgccccacagggacattgagtgaaggcagagcctgggagggaagtcagatccgtgcatgggtcccttcctgttggtgttggcgtccctgagtgagcagccatccgccgccccctggaaagagacctggagaagcagcttcaagctttggagcccagcccagctgctagcagcccctgggtcacagtgcgaagggggaaggcaggggcttgaggaagaaagtgagaggattgtgcctgggggcccctggagggccagtctggaggcgcgttggggtgaggcggtgctggctgtgcccgtctgagatgggcagagggaaggcgcccagggctgagcccagggtccccaggccagtccctcactgctctggggttcagtttcctcacctgcacaaagggcgggtcccgtgctctccggaggccacacggggtctccctgaggcactgagtctggcttgtttctggaaactgaggcacaggaggacgttgataaccggccttcctctgttctctttcccaggggtgcagctcgtccgtcccatggtttcagatttgcccggtgtgttgcaaccaccacctggcactcagcttgcccggtgccgcctggccccgcagcctttcccaggccttgcaagggtggcacagatggggaaactccatctgcaggggcgtcacccccgagggatgtgtcctccacactcccttgatggtcacgtgggtcccgggagggcgcgtgtgactcttcccaggattgcagcgttggggcgttgtgccagcctggccccgtgggtgcggagtgccgtggacccctcggccctcccgaccttgtttccctttgatgtagaagtctgcatggcatgaattccagtgacaatgggccgggccaggctccctgtgcccctggtactgctgcccagggccggtctctgcagtcaccctccttccttcctggtggctcctccctccctcctttgttcttcttttcctgcctaaatgtttatcgagtccctcctgcattaagtacccgtgctgtgcaacaaattaccttgaacttggtgacttcaccaccactgcatgtcagcgcccagccgtagacgagggtttgggaggcatggctgggcctgcccagggctccctggctgaagtgggtgctgaagctgccaggcactggaggctgggcctctcgcacactccctggctgttgggagggtgcattcttctttcttccttgtcttctagaggatgcactcttggctgtaggcctcccgtttctctcacgggctattcctggggttccctcagatcctggaggtgcccacagcccccttccccgaggctcccccccccacacactctgcgtccgcagaggtttgtgagggtccatgaaatacttgagttaccaggatgttcattttgcaacattttcaacatttgtaatccagtgaaatatcaataaaaaccccacagggttctggtaataggn

SEQ ID NO: 1086 - DNA, 565 bp, Homo sapiens
ccacgcgtccgcccacgcgtccgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttcaaaaaaaaaaaaaaaaaaaaaaaaaaaaaaaaaaaaaaaaaaaaaaaaaaaaaaaaaaaaaaaaaaaaaa

SEQ ID NO: 1087 - DNA, 600 bp, Homo sapiens
  misc_feature (547)..(547): n equals a,t,g, or c
  misc_feature (549)..(549): n equals a,t,g, or c
gggtcgacccacgcgtccgccaaatcccagtctttaccatttcatatcaggatcgttgtgtgagggaataacttggttttctgtcctcagtttttctcaatttcaatccatcttataaatcccagcaaaattaattttcctaaagacacttttagaatttctgcaatagctccttgagatcaggatgccagggatattcattctgttcatgacactagctagcacatttgatcagcgcttgttaaacgattctcaacccaaagatcactcctagggaaaaaagtctccaatggcttcccgttgccttcatggtattaaacctgcaattccagagctcgatatttaaattttttagggggctggaatttctcataatactccttggctatctactaaacactaagtactaggcatacagaaataacagatacacttgggtcaggcacggtggctcacgcctgtaatcctaacactttgggaggccaaggtgggtggatcgcatgagctcaagagttcaagactagcccaggcaacaaaggatcctgtntntacaaaaaaaaaaaaaaaaaaaaaaaaaaaaaaaaaaaaaaaagggcggcc

SEQ ID NO: 1088 - DNA, 545 bp, Homo sapiens
  misc_feature (530)..(530): n equals a,t,g, or c
  misc_feature (540)..(540): n equals a,t,g, or c
  misc_feature (545)..(545): n equals a,t,g, or c
gaattcggcacgagatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggccsgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgaaaaaaaaaaaaaaaaaaaaaccncggggggggnccggn

SEQ ID NO: 1089 - DNA, 913 bp, Homo sapiens
ggcacgaggaaggccctatctgacctgcagtgatggggcatttgcactggggagtttctgggaactttttcttccccagactttctctgtttttactgtttgcttggctacagattacacaggcaaatgagcccaggcttccagggaaatattccattaaagcaatcaaaataacaatttgtatcacttttagaacttctgcctgaggagctaagaaatctttgtactaaattattaattctgggttgtactgtaaggatcttcccctacaaacaaacaatttaatatttcctttttggtgcaacagaggacgagttctccggtctcccagatctgcctcaaaaggagggaggaggtatttaaacccagactgtgatacttctaaggaaactgcctaacagaatgtgtcccgtccctctcggaggaagggatggactgtcagcctcggtaaccttgttctcagggacactcgccgctcccacttatggtcgggctgcacctgtgctggccacatggcaaggcggtaagagccagagctctggagtccctggtcctggaacctggcgtgcgtacctgctggctgtgtgattgggatagtttgctccccctcactcagcatcagtttctccatccacaagaggagggtagccatgccgatatgctagcacagagctggtgtgaggctcccgtgtgtctccaaagtcttggacagtgcctggcacgtgggagacgttcagaggatgttatttattattatttgcattctcagggaatgtctcagtgatatagacacggctctgcctttcaccaggggcaacgggggtggggtgcacagagagtgtgtggggaggaggatgaggaagagggtgccaggtagggaagtggaaagaggaagaaaaaaaaaaaaaaaaaa

SEQ ID NO: 1090 - DNA, 871 bp, Homo sapiens
  misc_feature (8)..(8): n equals a,t,g, or c
  misc_feature (865)..(865): n equals a,t,g, or c
  misc_feature (867)..(867): n equals a,t,g, or c
ggcasrrnagacagacctgagtgccaasgktgtgacctcaggcctctccaggtctcagtttccacatccgtgaaatgggtgtgatgagagggtgacgaggaggggccaggacggggaggccacggggaggccaaggggttggggcaggactggtcacagtggctccaagtgcccattcaggcagtargcaatggggttgaggtccctgaactctctctccagtgtgatgttcttggtgcatgggggtgcctggggtgctcccaaggcctccgcccgccacctctgtctctccctgggcctccatccttccacctggctctggaatcacaaccggtggtagccagtccccaggacagcttccagtcccttagatagtcaccctcatgagcccacccagcctctgggttgacataaacacccccagcagcccctarctgcctctggctgacatcaactgtakgacatggggcctggaacctgggaaacagctacctcggggggaatgctgttggtgagggccaggctctgggttcccatcccagctgcttactaagaatcatggggtgtgtaggccgggtgtggtggctcacatctataatcccagcactttgggaggctaaggtgagtggatcacctgaggtcaggagttcgagaccagcctggccaacatggtaaaaccccctctctactaaaaatacaaaaattagtgggcatggtggtgggcgcctgtaatcccagctactcgggaggccaaggcaggagaatcacttgaacccgggaggtggaggtagcagtgagctgagattgagccattgcactccagcctgagtaacagagtgagactccgtctcaaaaaaaaaaaaangnaaaa

SEQ ID NO: 1091 - DNA, 672 bp, Homo sapiens
agtgctctgttgcccaggctggagtgcgttagtgtaatgtcagtccactgcaacctccacccccaggttcaagcaattctcatgcctcagcctcccaagtagctgaaattactggcatgcaccaccacacccagctgatgtttatttatttatttatatatttatttattttaggtgttttttttttttttttttgagacggagtcttgctctgttgccctgggtgtggttacgtggrattaccatyctgggtgactcactgaaatgtactcmcagtgagtcatgccttcmaatgacatctcaagttctgcctgcttggagatacatctggggatcttaaggggtgagggactactcaacaagaaggaatttagcctgtctttttaaataaacggcatttctttttcctakaaaaatgggaaattcttcaattctctaatacagggacactgagataacaaagaggaaagtgtctggttggaggttgggargccaccctggggtctctcctacaaaaatggaaaagaaaagaacggtgaraaatcmagcaaagcacaaraaaktttccctttgctaaaagggaaaagatgccccmcaatgcccataaacatgaactggggataaggaggaraatgtctctycttggcacccccaaacaaacgttaattaccc

SEQ ID NO: 1092 - DNA, 2631 bp, Homo sapiens
  misc_feature (2619)..(2619): n equals a,t,g, or c
ggcagagccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactgraatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacactkgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcarcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttyctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaaaaaaaaaaaaaaaaactcgagggggggcccggtacccaattcgccagagagtgncaatggcatcaa

SEQ ID NO: 1093 - DNA, 1326 bp, Homo sapiens
ccacgcgtccggcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagcaaaaaaaaaaaaaaaaaaaaaaaaaaaaaaaaaaaaaa

SEQ ID NO: 1094 - DNA, 427 bp, Homo sapiens
ggcacgaggtcatttcagccttatgaattgcccagaataagctagatcacctttaaggccatgtggttagggaaacttgggcacagaatttacattttcaacttggtgataagatgggtttaaggtaagaatcaaataggagaaagccttagctgttccagcggcccatgtttaaaagaatgtgcttctttttccaagtatttctgccgcttgcatgcactgagcttctttggaaaggagcaccatgcaggcatattttccagacaggaccggatttgctcgttactcagaggtgtgtgcattctttgcttttaggatatttaattagcatcttttaatagtgatattacggtgtcttaaaagtttatgcatttgaaaaaaaaaaaaaaaaaaaaaaaaaaaaaaaaaaaaaaaaaaaaaaaaaaaa

SEQ ID NO: 1095 - DNA, 1767 bp, Homo sapiens
  misc_feature (26)..(26): n equals a,t,g, or c
  misc_feature (68)..(68): n equals a,t,g, or c
  misc_feature (80)..(80): n equals a,t,g, or c
  misc_feature (107)..(107): n equals a,t,g, or c
  misc_feature (1762)..(1762): n equals a,t,g, or c
aagaaaaaaataggcctggttgccanattaaggtcccctgggctattttaaaccggatttggataccnaggtctttccanaggccgtattttgccccccgtaacccntaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaaaaaaaaaaaaaaaaaaaaaaaaaaaaaaaaaaaaanggggg

SEQ ID NO: 1096 - DNA, 1487 bp, Homo sapiens
  misc_feature (1486)..(1486): n equals a,t,g, or c
ggcacgagcctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgaatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgrataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatmtattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatggatataaccagccccaaaaaaang

SEQ ID NO: 1097 - DNA, 1625 bp, Homo sapiens
  misc_feature (1336)..(1336): n equals a,t,g, or c
gaattcggcacgagaatctaccagccatgagtgaagtctacccttggaagactgattgtgctcagttcggctctaaataaaatctttccattaactctggcttccagtgttttgtactctgggagaaccagtcctccaagggagagttttgtcagccagctgaattgctgcttcagtgacaaaatggaattcactcaaattgttctgagctttaggacaaaagaaatgcctgtcatcttcctgatagtgaacttagcaaagcaccgtttaaaagaatggctctcatcactcccgagtaccttgtcattactgctcatctgtgctaagtgccactgtctacttctgatccccaaaacagtggsctctagcctttgccttctgcctaactccaagtagagtgttctttttataatccttcatgttcatataacactttagcatttacagagtgttttcacatgcttatttgtgaggtattatcacagtgctaraaataaggaaaggctgagacctaccaaaatgacagtgttgtacgtgagcaggctgagccttgaaagcaggacctctgtctcccacattagcgcttcattccatcacacctctgcaaggacaggtagcctgctggggggccatggtggcactggggtataaaatctctaaactgctaatatcctcttttccttctaggctgagaacatctctaaggamctctacatagaartatatccagggamctattctgtcactgtgggctcaaatgacttaaccaagaaamtcatgtggtagcagttgattctggacaaagcgtggamctggtcytccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggttgttttttgagacagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctgggcacagctggtnttgggtctgccgtgcctcccttccttcctcctcttggggccactggctgctccagttccccatccgtggcaagccggtagagccattcatccccgcagccttyttcctgaccctcgtacagtttcaaatgcagcagacagccaaagcaatgagtggggggctgtggaacttcatttcccaaaggcagcgccagtggctcctgagcaatgagaatgtcctgtcctgtccaccatattcaaggccagcagaagagcccgattaaaccctcgcagcacctggcctcgtgccc

SEQ ID NO: 1098 - DNA, 925 bp, Homo sapiens
gatttaaatgtgttgtttctttttaaaaacattgaatctgtggttgggttatttctgtcaatttatttgccttccttgccaagtcacactttgcctaattgatgtcctgtgtgttttccattccgttcatgctgaattatcttaggtcaaagaggaaatcatctttctgcctccaaccttcttacttgcctctaatcccctttcttgactcttccaagtcaggattctcaccaaggaagctatctgccttctttgggaatgttgggcttatgaagacttggagataatggggttcatgtattcagactctttrgcatwtacagtagagtttctaatgttgtcagcattccctagtgggcagttacaagttaggttgggattctaatcatatttatgatastcacagattaaattgcactttgtctctgccccagtctttgattcccttttggccagcagtttttaggtctgtcagtactgcactgcargaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtaagtacccacccacgttgtctttatgaggctggaggggtttccatgggagtgttgcatttctgtggttccttgatatctgagttttcatttagggtggcatgtgatagtggtggctggtcaccctgttgtttttcagttgagatatatcggaggaaccacccccaataattcaacgtaggttcttttctattttccctaagtgtcggctggtctgagaaataaagggaaaggatacaaaaaagaaaaaaataaaaaaaaaaaaaaaaaaaactcga

SEQ ID NO: 1099 - DNA, 1061 bp, Homo sapiens
gattcggcacgagaaaacctgaacctaagtctgtggttcctagtggcccagtgctggctaatgtttccatgtttggagagaaacagggaaccatgcaggtcttttttctctctgaaattgggatgctgtgggtggtggtaaagatggcccactcagccatgctggtttctcacacccaggacccgactccatccagatggccatgctctcttgctcagagcattctgctcacctgcagtccccagcataggttctcattggagagaaaaattcagctcccacccaggagatggtgggcagaaggcagggaggggtgttgggtaagagagagggttggggagaggacttaaggggatgctgatgaatcagctcactccatagctatcccctggaagcttaaagtaccggatgggtgagagagaggcagatggggtggctactacagagggaaaggagagagtaggacacaggaaccctctgggccaggtggggagaggcagggggaacctggtgatggggaggagaaagcctgaagatgagggtgagcattgcgtggctctggaggtgccattcacactgcactttctgtgaatgtgcccatgaggttgtagaatatgtggcctgcacacccatacatggcagtcctgcctaaagggacccttctgtcttcacgcatgctaaaagactaatagcctgaaatagcctgggcattttgagggaggaaaaagcagctccgaggcccacctggcctagcaaagaccatcttcactgatggctgcctcaggcaagaaacaagcactgtgaaccatcaggagcttatcagtagcttggttcacagcstgaagcagtggaaagccacagggtataggatgcaaagtattgagttcacgtcccagttctgctgctactagctgtgtaatgtccaggcagatcgctcgtaacttccccaagccttcctgtggtccctagtggctcagtgctggccgaagtttctacatttagagagaaacagggatgaatcttaaattcagctgattgaaaaaaaaaaaaaaaaaactcga

SEQ ID NO: 1100 - DNA, 1301 bp, Homo sapiens
aagagggtggctgccgagttcttgtttgtcctgtgctctgagagtggtgagttatggagacccaggtcccagcccaccccacctcagccaggcttgcacactgacctctgccttgcccctcagtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaaaaaaaaaaaaaaaaaaaaaaaaaactcga

SEQ ID NO: 1101 - DNA, 2379 bp, Homo sapiens
  misc_feature (44)..(44): n equals a,t,g, or c
  misc_feature (1881)..(1881): n equals a,t,g, or c
ggcagagctagtgtggactccatccccctggagtgggatcacgnctatgacctcagtcgggacctggagtctgcaatgtccagagctctgccctctgaggatgaagaaggtcaggatgacaaagatttctacctccggggagctgttgscttatcaggggaccacagtgccctagagtcacagatccgacaactgggcaaagcctggatgatagccgctttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtsgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccayatcaggaaggagcaccccaaacagacagaaaacgccacgaggcaagtgtagtctctcacagcctggaccctctgtcagcagtccacatagcaggtccacaaaaggtggctccgattcctccctttctgagccarggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccmtcggtgtggcagctttagcctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggccnattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaagatatttatgtatgtacagtttgctaaagccaagttttgtttgtattgatttctttgcatttattatagatattataaaataaaaaaaaaaaaaaaaaaactcgagggggggcccggtacccaattcgccctatagtgag

SEQ ID NO: 1102 - DNA, 793 bp, Homo sapiens
ggcacgagccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1103 - DNA, 981 bp, Homo sapiens
cccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagagaaaaaaa

SEQ ID NO: 1104 - DNA, 1025 bp, Homo sapiens
ttttttttttttttttttttttttttttttttttttcaaatccaacttttatttattaaattaaaaaaaaaagactccacaaagggcatgatcccttccattccacaatgttctctccccaagctccagcggctttaaccctttaacttggggccttgagacagcaggggacagaaaaggaggatccaacgttacaggaaaggcacgaagcggctttaaaagtcactggaggtggagatgggagcatccaaagtcccagggtgggggtgcgtggatgcaccaccagatcagcttgggggcctctgtcctcctagctctttaagttctttctcagggcttctaggcaccagatctagcatagtgccttgcacagagtaggcactcaatacatacttgatttatttgaatctgatcctagagaaagccttccccacccattcttcaggaggtgcacccccaaaccaatgtcctcctgttagatgggcttccccaaagagcacatctaagatggcagctgcaagctctccataaccatggcaacaggggattaacctgatggggtcatggtgtctaaggggtggggcagtggaggaacctgctctgcagtcaagggagatggggtacattccagtccttctcccctccataggacttgaggtttcacagcttctggctggggctggggatattagggatccccctaatcaagagataccccatcaactgtttagcagagatgtagctaacccaatttgtagagacttcattacaagagaaaccctatcaactgagattctgatgatagacattctattaacaagatcttctccactaacattttgtctatacagagatgcatttgactagaatttccttagcagaaatggatccacttccctccccagctcactctacctgacccgtcatcataacttacataaatagaattattactattcattactcctggtacataggggttaaatatacaggcctgggggcagcctccctgaccctctcgtgcc

SEQ ID NO: 1105 - DNA, 999 bp, Homo sapiens
agcaaatcaccttaacgatctggaatgaaactgtgaccagtgccgccctgggtggttctggagagactgccgtcttcttgtttggccataggtgctggggccccggcttcagtcactgtctcagacagkagtcccgataagcagatcaccagtcctccactgtccttcctgtcggccttgctgcatgagaagatagctgcttcctccctcttttcctacactgtaaattattgttttacaattgagtgycttaataatagtytacaaatactatgtatttatgcaaaactgttaaagttctcatctgttatgattggatacttggtcttgtcagtagtggtcagcattgggttgtgagcttgtcctactccatacgtgtttatcctgctatgcattttacattgtgtgttcacatctattccaaggagccttgctagaaacaacactggcggttcctgcaggccaggcaggcattggcccatgctgtgtcccataggagccaatggaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgatkttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaaaaaaaaaaaaaaaaac

SEQ ID NO: 1106 - DNA, 3522 bp, Homo sapiens
ggcacgaggttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggccctgcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcagatcgggaggaagaagaggtggaggtgtggttgtggtggagagcaccagctagccccttccagaaggggaggccacatttgcccggccccctggagctgggtctgagccccagctgaagggactgagcctcagatggctggattttctctcaggggcctcctgctgaaggggccttcagaggattttatgctggaaatatgaccctgtgcagactgctgggggaggcaggaggatgcctgcctggaccctgttggtggctgaagacctctggccagctggcttccgcccttggtggggaagcagcagaactaggttctgagccacgggtcagggtgccaccctgctgctggccccactgtgtcacagagctgcctggcacaggtcccagcccctctgcagagacacaataaaagccagcagaccctttggaccgaccaaggctggtggggacactgtgaggggaccagggcccctcagggatgtagaaacagcttggaggatgcctctgccccaccaggaggggccccaggccctggcagggcagagaaggaaggggcttggcttgggcctcctggtcctacgccatcactgcccttgacaaatgattggtgttgggaaaggacctggaagtgccctgggacctgggaaacatttagctcaagaagaccttggagcaacatgatccctgtcctcagatgtctggggacagtcattgagcaagcacagggaagtcagcttgttctctctggcagcgctggaagacagtcaacctgtgggtggggggctgcagggggacaggccgcagccctgcaggaggccgtgctccgcaatggctgccctaagctgcatgggtcagacagcttcccgtctcgggaggccacagggcagggaagctgcagagggcatgtggccctgggtagggcagctgcccttcactcatgcccctcccaagcagaggagggaagggctttagtgagaattctagctctgcctctttgaccttgccaagtcaggatctgcctcttaaaggagcagagaaaaccatccagatcccctcgacacccagccccctaccactgacagagcacaagtgagatctgagtgttagcccttcagatttgctgactggccttggcccacccctccctgtgctgcagcttcattggcaaaatgaatttgatggtatctgtatcccctgcccagccctaacctgtttctctgaggctggcctccctacggggctgcagcagcaaagggaagccaagccttagagaagcctcatggaagggcccagaacatcctgcacccatcagttactcggaagtaaggggacaagaagcagctggaagagagctgggtgtgggggctgggaggagtgctggagaaatttccccatcagaaggcccctcactgggcagtggaggcagggcagtgtggtgggactgactcaacagacatagtttcatctccaccctgcccttctcaggttgtgtgaccccagccacatggacacccgagtctgtgaactaaagggctggtccatggcattaacagtggagggtgtccaggttcttgatgtcttgaacaaagaattgggcaaaatgcacaaagcaaggaaggaatgaagggttttactgagaatgaaagtatactccacagcatgggagagggcctgagcatagggactcaaggggcccgttacagaatttttgggagtaaatacccactagaggattccattggttacttgaggtacaccctatgtaaatggaaaggatgaagtaaatttacaaattcatttacagcatataccctatggggaggatattccctgttatagctgaagcgtgaattggccttatgttccctgcctccagaccctattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaactttctaagaaccaggcctggttggcagcagacctagctttcttggggtggcagggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttaaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacctccttcctcctgggctctttcctctaataccgtcatcctctctccaacctggttaatcctgtcctttctgccctcaaatgggcaccttcaaaaaaaaaaaaaaaaaa

SEQ ID NO: 1107 - DNA, 1441 bp, Homo sapiens
ggcacgagttttatttatcttgcctagggtgtgttgggcttcataaatctgtggattggtatctttcgtcagttctgtaaaagtctcaggtactctttgttaacattcgtctctgccccatttttcttctagaattatgatcaaacatgcactaattagaccttttattgtattctctttgcttcttaggctatgctctgaaaatttattttgtcctaatactcagtttatagttctgtcttgtttccaatctgttgttaaatccctcctttcaattttaaatctcagttactgtattttttaattctagaaggtcgtttggttctttcaaatccactagatcaagtcactctctgtgacttcctacgacctatattctagcctttgccttttattattttttaacattgtaagcaaagttgttttatagttgataattcttgtatctgtggtctttgtctcttcatactagctgttatttcttaacagttttccctgatcccaccttacttcctcatagatttgattatctttgattatgtgctgcttattttttttaaagataattatctgtattaatatgagacctagattttaagatacttcccctcaggattgtgctgtgtgcctgggcacattgcaagtccaaattactttaaagtatcctagaacaccagaggtgaaaattcatgccattctcgtgcatctttaccttatgggtatagcccattgggaatccttagtgtcgggagggagttctattacaccttccacttcgggcagatcctgggctttgacattcgtcctcttcatcataaccaaatatcagacttgcctaatgcgtaaatgcccttggggtaaagcatctgtgttctgcttacctctcagggttcctgcttttccctttagctttggttccatcacttgtgtgttcaaccagtatgggaaactgcctctagaagcagtgttttaaaattttagtctaaccataaaaatagagaatgcttaccctctggatataaatgccatagcgataactttgaactcctacattacatgccttttatgtaaggcaaacctcagtacacattgagagacagtgtcatatacttattaagatcacaggctctaaaatcagactgccttgtttaaatcctggccctgccatgtagtagtaacctgtgttaatttatgcaagatacgtaatctctctgtgccttggtttcttcgtttaaaaagcagaataatagcttgcctcatgtggtcattatgaaaaacaaacaaggccgggcaccgtggcttacgcctgtagtctcagcactttgggaggctgaggtgggcagatgacctgaggtcgggagtttgagaccagcctgcccaacatggaggaaccccgtctctactgaaaaaaaaaaaagagagagagagagagagaactagt

SEQ ID NO: 1108 - DNA, 1474 bp, Homo sapiens
ggcacgagctaaaatatgcttaaagtaagatgtttctatgttatgtggttatgttatcaataatatttggttgatcttcacatattttatatgcatatatatatcaagaagttatatatatataactcaagaaactcaagttatatatatatgtcaagaaatgtatgattattttggagagaatgggcccaaatgtgaaaaagatataaaaaaaacaaaaaaaacaaaaaaaaaacactattttcccctacgaaatatactgtatatttcaaaagaagaaaagttaaaagatatttgaagattgcaggggcaaaacaaaaacctaccagggctcagcacttaagcacttttcccacatccagggtcaaagcagcagtaactacatggacttttaagtgcggtatgaaatgcaacattacgcttacaaacagtactgtcaaacctcaaatgctttctttcttcagatgctttttcgtgtacatgatactagtagacacttttctctttatatttactgatagtgaaaatcatacgcaataaaatattgatgtttgaaggcagtggtcaccaattggttaaaaaactatgaaatgtaaactgaattgttatatctctatcctttttgcttttctctgtgtttttaatgtatggaataaatctcataaatagaaagaaaaataatctagaaatttttcaaagctagtactctttctccttataaatgtacacaattttaatctttttacaaatttatttaactgtacctactgtacttattgtagattcaatgacgcagttaagtcatcacccaaggatttatgaatttgagattactgacctgttttcttcatattgcattcacatcaatatttgtgaatttgttgttcagcttttcattcaaacaaaaaatattccctcaagaaagctccctttttatcataaacatttcaacttacccaacattagaacaagtctgccatgttaaaaataatttaaagacttatctctgaaaacggtatccagaaacgcaggtgttcccagtaatgtagcttcaaaaataaaatgtgctatttatatgactgaaattcataacttttggaagggtatatttatgacagcataaaaaataaattctgtgctataaagaagatccaacaaattaaccatataagcacagaaagtagagaaacacagttattgaatctactcttgtcattaacattttcaaaaaacaaaatgcatattgtaatatttggtacatgacacttgcatgttgatatgcctatatacttacaaagtattcaatgtgtacttagcggcgcttaaaatatgtcatgtacaactcttataaacatttttacagggttcccatttgcacttcatctttcagtaaagtcttgtcagaaaaaaattgtctgataaatatggaaaaataaaatttgaattttagttaaaaaaaaaaaaaaaaaaaaaa

SEQ ID NO: 1109 - DNA, 1674 bp, Homo sapiens
ggccacgagagtatctgcggcagctgcaggtcctggatttatttctcgattcgctgtcggaggagaatgagaccctggtggagtttgctattggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggttccggaacctggcacagatcttcctggaggacttctgctccccccgccaagtggccgaggcccgcagccggcaggcgcaattttgccctgggtatcccactgccgaggagcgtggccccacggcagcgctgatccatggagactgcgagaccgtggcacccctactgctggggaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaaagatgaagatgtggtccctgcccttgagtgacagccccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactaaaaaaaaaaaaaaaaaaaaaaaaaa

SEQ ID NO: 1110 - DNA, 2512 bp, Homo sapiens
ggcacgagggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgctcaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcaaaaaaaaaaaaaaaaaa

SEQ ID NO: 1111 - DNA, 3998 bp, Homo sapiens
cctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaaa

SEQ ID NO: 1112 - DNA, 2083 bp, Homo sapiens
gccctttacccccaaccccaggccactgggcccttcccacaccacttggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatygctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtggrggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaaaaaaaaaaaaaaaaaaaaaaaaaaaaaaaaaaaaaaaaaaaaaaaaaaaaaaaaaaaaaagg

SEQ ID NO: 1113 - DNA, 1023 bp, Homo sapiens
gtcaccaggcccccactcaatctcagcttgggaaccaaagtcacccaccttggttgtgttggggtggacccgccatctgtccctggtccagacgagaaagaggagtctctcctaggcctggagctgggaaagaatgtgtgccccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagatgctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgcaaaaaaaaaaaaaaaaaaaaactcga

SEQ ID NO: 1114 - DNA, 1484 bp, Homo sapiens
cggcacgagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctggggagccttcctggccagtctgagtggcagccagaagggagctcatagtgtctaggaatctcaggcaaagtaggtcagggtactgtgggcaggggggatgtgtgtgataggagagggtaccctaaaccccataccttccctccctgacctgaaaagctgatctcaacagggattcacacagaattaggctgtgtttttgcattaactggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaacaaaaaaaaaaaaaaaaaa

SEQ ID NO: 1115 - DNA, 2374 bp, Homo sapiens
  misc_feature (556)..(556): n equals a,t,g, or c
  misc_feature (2344)..(2344): n equals a,t,g, or c
  misc_feature (2346)..(2346): n equals a,t,g, or c
gatcccaccacaacttaatgttaacattttaaattatttctttttttttcatacatatgcatagacaattactgggtttttgttttsttttttgtttttttttcaagcgacattgtgattgtattcttttataccttattgggtttgtwtttttacttaccatggtaaaaatccatttgagtgagcattcttgagtggttttgcattgtgtcttcacacagttgtaccataattraagctgcttttggccttgctctggtaaagcagtgtagcacacactcttaatttctaaggaagtgtagcgttcccttgatgaatcrggagagagatcatgaacttggtgtatgaggtacwctggtctgtcttttcaagctggggtaagtaggcatctgcaactaccagtcatatattttgtaacccactggcccgtgtgtgccctgattgctgaggctagacagatccatcagggcttagacagttagtgagggtcctgggagtaggcgaagggaagtccagttaatgtgtgaagctgctgggaattgtgtagttggcaganatttgagcaggtaaagcttccgatgtggaccaagtacaagtactaagatcacggcacatcctctaaaaggaagtcagatatttgggactgtccaggaaatctgggagatagtgtgatggtggcatagctctttctcatctgacactttttatgcttactcagagtacgaatgccaagtattgagacaatacagaataatatttgaattgagatattcctagaaagacaggtcaacatggctcttggtcaagaatgacttagagttccttgcctagtgctcggctggcttcatgtcatagttgaggctgggtccacaggtgggataagattccaccaaagctcaccaggctggtactgaccccagagtgtctcccaggccctaccttattttagcattcttttgaattgagtttcagaggtgattcagtagtaaatgtatggggagaagaattagaaaaacccatctctttttaagcagtcatcattcttaaacatctgaattgttttacaacagagtcagcaaacctttctagcatttctaaaagatggcagtttcttggagaccacatctttgcaaggcagtattttcaaaatataaaatagcccccaaaccaaacctttaaacatgaagggcaaatgggtaaagacttaatattctttttgtgtcaagtatacttaatgtaaatctagttgcttgtgaagtagtaatagtaatagctcctattattttgagcactgactatatgtgctcagcctctgtgcttggatctgacatcactatctcatttccttctctcagcagttctggaaggagtacctaccctgggtatgctttgcccagggtcacagaagttactgaattagagcagggattcaccccaagtgtaaaaactcaagagctcctgcacttaggggtttacttcactaatcatctaacctcatttattatgcttaaggctttttctcagctgacctgactttgctttaggtcattcttttttatgccagcactgtttgaaagtgcatgtcaagcggctagctccacatttggtcttcgaaagggaaacgcatgcagttaaaacgtaatgtacatgatggaattgggaggatcatagtctcagtttcccccccyctttctcccatctaggagacctccrtggactgcagcaaaattaaaaataaagcacagacaacagaattattcttcactgagagagtttaatatgcgtttctaacaccatctatacttgctttgttgttcttgaggtcatcaacacacattctggttattccagagctagaagctcttctggttgctaactcagttataagaagatgaaagacataactagmcttacgtatttcagtagtttgcyctttaatttttcccytacycytagtttccaggcgacctcccaagaagggtatcagtcgactggataaacagatgagaaagttcacagatataaggaaaaaaagcagatcygcacacgcagtgaaaatcagcattgagggcaacaaaatgccattgtgaccttgccyggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtwaaaaaaaaaaaaaggggggccncnctaaaaaaccaagcttactttcccttgc

SEQ ID NO: 1116 - DNA, 1328 bp, Homo sapiens
ggcacgagctcgtgccgaattcggcacgagagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtcccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaaaaaaaaaaaaaaaaaactcga

SEQ ID NO: 1117 - DNA, 781 bp, Homo sapiens
gaattcggcacgagaagagtatcatatgcagagtttcccttggtaaacatatttaaaataaataaatctggaagtgtctgagagtcaaaaatgtggtgcatgcaatatatgatgtaaaacaaaggcgggtggtttacgtagctcagcagacaagacgccagatggtatgtatgcttgattgaaagtacccacctgttattctgcgaacacaatgggaggaacagaatcctacatttcctcatcccctttactgaggactctccttctttcatacttagtatttttatattacctgtatctattattctacgtggcaagaagtccttttgggaaggcagagtataaataatgtagttttattaatagataagtattagtaaaactttgcattagaagatgtatgactgacgttgcatagagttgtgtgatgtagagtaatattccatggtgtacacatccataattatgtttgccgaaacatgaataccctactacaggtctttgtgatagacatcagggtggggatgcataggggacaaaaatgtacacaattttgtgtctgctctcagagagattacatagtaggagaggaagacccagtattaaaaaatagaataaaggcaagtgccccaaatctttgtcattaattttractggaagagaggcttaggaaagatgagacatttaagcattgcatggaggaaaaaagaagtagatctccttggcaggtggataggctaggacattccaaactgagaaaaaaaaaaaaaaaacgscacga

SEQ ID NO: 1118 - DNA, 1664 bp, Homo sapiens
acgcgtccgtcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctgggtg

SEQ ID NO: 1119 - DNA, 2382 bp, Homo sapiens
  misc_feature (2108)..(2108): n equals a,t,g, or c
ggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcnttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaaaaaaaaaaaaaaaaaaaactcgagggggggcccggtacccaattcgccctatacgtagc

SEQ ID NO: 1120 - DNA, 2208 bp, Homo sapiens
  misc_feature (2198)..(2199): n equals a,t,g, or c
cctcccggtaccggtccggaattcccgggtcgacccacgcgtcccggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtmtttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaamaaaaaaaaaaaaaaaaaaaaaaaaaaaaaaaaaaaaaaaaaaaaaaaaaaaaaaaaaaaaaaaaaaaaannaaaaaaaac

SEQ ID NO: 1121 - DNA, 1192 bp, Homo sapiens
ggcacgagtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagaggacggacagcagcgagccctgcggcctctcagacctctgcaggagcctcatgaccaagcccggctgctcaggctactgcctgtcccaccaactgctcttcttcctctgggccagaatgaggggatgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagaatactggaaatggtgcccgtaacatactaagtgccaagtaaacgttacctgctgcctcaagtgatgacgtcccattaagtgggggctcctccggaagctgccagaagaggccgctgccttgtcatcggttctctggttcccagcttacagctcttccctcgagctctgactcagtgtgactatatctgaatgtgttccctggagctctgacactaatttagcaataaaaccttctgggacattaaaaaaaaaaaaaaaaaaaaaaaaa

SEQ ID NO: 1122 - DNA, 1866 bp, Homo sapiens
ggcacgagaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtaaaaaaaaaaaaaaaaaa

SEQ ID NO: 1123 - DNA, 2879 bp, Homo sapiens
ggcacgaggcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaaaaaaaaaaaaaaaaaa

SEQ ID NO: 1124 - DNA, 1187 bp, Homo sapiens
  misc_feature (1054)..(1054): n equals a,t,g, or c
  misc_feature (1081)..(1081): n equals a,t,g, or c
  misc_feature (1087)..(1087): n equals a,t,g, or c
  misc_feature (1167)..(1167): n equals a,t,g, or c
  misc_feature (1176)..(1176): n equals a,t,g, or c
  misc_feature (1178)..(1178): n equals a,t,g, or c
aggtccaccccgtcagaagttaacttttaagtgagagagtcccccccacccccccaaccctgcttttagagaacattttactaggccaggacaccaagtatcactgtgtatattctctgtaaagttttaattataaaaaaaaaaattatgaagttggtcataagctgtagacaatctggtgtgctttgcatgtcttcctgtttgatcagtagggatctttgctgcaggcctccattttgttttatgtccttggggacgtgacctgtaaccacatggcaatattttgctttagcctctgcagtctgggttcaatcctgggtaaaggaatgagtacttttgggtcgatatctgtgtgactttcgccatttggtgattatcttcccttcatgaacaactcttgagttttatcttaaaccttcctttttctaagttgcctttaaaggttttagattttgtggccaggtgcgatggctcacgtctgtaattctagcactttgggaggcggaggcggttggaacatgaggtcaggagttcgagaccagcctggccaggatggtggggccccgtctctactaaaaatacaaaaattggccaggtgcggtggtgggcatctgtaatcccggttactcggaggctgaggcgggagaattgcttgagctcgggaggcagaggttgcagtgagccaagatcgctgcactgtagcctgggcaacagagaaagactccatctcaaaaaaataataataaaatagattttgtaagaactgcttacccctttgaaactcacagttaaatcataaccttaattggtgcttgttggtttcacctgtacagttacttttaggaaagtctgaaaaccagaaatattggctgcttggcacagctaaagcaggtaatggggaatttaaaagaattttcttaaagtacattcagcttaactaaaagtgcatacccagattttatacacacacacacacacacacacacacacacatatatacatttttttttttttttgagactgagtctcgctctgtagccaagctggagtgcantggtgtggtctcagctcattgcacctntgcttnctgggtccaggtgattcttctgctacccttccgagtggccggtactcaggtgcacaccaccatgcccagataatttttgngttttagtnanacggggttt

SEQ ID NO: 1125 - DNA, 457 bp, Homo sapiens
taatttttgacatataaaattatatatggaaatttctaaaatatttaaaaatttctgtaatgtcaatagtaatgtcccctcttttgttaccaatttgttatttgaatcttctccttttttttgtcaatctagctaaaaatttgtcaattttgttcgtctcttcaaaaaaatatacgtttgtcttcattgattttctctattgtttttccattctatatttcatttgaatacatttttaaactttatctttattatttcattccttctgggagctttgggtctcatttttttttcctgataatctagttgtttattgtataagattaagtatttatttgaaatctgtatgttctttaatgtaggcattcactactataaatttacttctcaggagcatctctgccgcattccatgttttagtatgttgtgttttaatttgtattcataactagaggga

SEQ ID NO: 1126 - DNA, 1212 bp, Homo sapiens
  misc_feature (22)..(22): n equals a,t,g, or c
  misc_feature (1184)..(1184): n equals a,t,g, or c
acggggggatgtaaagggaaanacttcctcactaaattgaacaaaagctgccagctccaccgcggtggcggccgctctagaactagtggatcccccgggctgcaggaattcggcacgagctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctrcctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttycatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgmcccctccccgagacctgtcctgccgtccgcgggtgtgtggcctgtaggggactgagagctgggcttgctgggcacctctggaatctgaccctgtgggccggaaaaaaaaaaaaaaaaaaaaaaaaaaaaaaaaaaaaacnaaaaaaaaaaaaaaaaaaaaaaaaaaaa

SEQ ID NO: 1127 - DNA, 902 bp, Homo sapiens
cgactgctgaaggctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaattccagagtcctggtcagttcccaggttggctgaaggcttgatgtcagcactgatgtgatcgaagagtttaaaagcaagttttaccacatgggagcaagcctgaaccaggatcaaaagtcctagaaagggggtgcccttgctgcagactccgggctcggaacactcaagcgc

SEQ ID NO: 1128 - DNA, 2084 bp, Homo sapiens
  misc_feature (839)..(839): n equals a,t,g, or c
ctatcagatgctgggcctcctcagccatagccccctgctcctaccccctgactggctcttgtgtcctcacctctcaccctctccttcctgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggnaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcrcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatccaaaaaaaaaaaaaaaaaactcgagggggggcccggtacccaattcgcccctataaagagtc

(The sequence listing continues in the following parts.)

What is claimed is:

1. An isolated antibody or fragment thereof that specifically binds to a protein selected from the group consisting of:
   (a) a protein whose amino acid sequence consists of amino acid residues 1 to 283 of SEQ ID NO:5761;
   (b) a protein whose amino acid sequence consists of amino acid residues 20 to 283 of SEQ ID NO:5761;
   (c) a protein whose amino acid sequence consists of a portion of SEQ ID NO:5761, wherein said portion is at least 30 contiguous amino acid residues in length; and
   (d) a protein whose amino acid sequence consists of a portion of SEQ ID NO:5761, wherein said portiuon is at least 50 contiguous amino acid residues in length.

2. The antibody or fragment thereof of claim 1 that specifically binds protein (a).

3. The antibody or fragment thereof of claim 1 that specifically binds protein (b).

4. The antibody or fragment thereof of claim 1 that specifically binds protein (c).

5. The antibody or fragment thereof of claim 1 that specifically binds protein (d).

6. The antibody or fragment thereof of claim 4 that specifically binds protein (a).

7. The antibody or fragment thereof of claim 3 wherein said protein bound by said antibody or fragment thereof is glycosylated.

8. The antibody or fragment thereof of claim 3 wherein said antibody or fragment thereof is human.

9. The antibody or fragment thereof of claim 3 wherein said antibody or fragment thereof is polyclonal.

10. The antibody or fragment thereof of claim 3 wherein said antibody or fragment thereof is monoclonal.

11. The antibody or fragment thereof of claim 3 which is selected from the group consisting of:
    (a) a chimeric antibody or fragment thereof;
    (b) a humanized antibody or fragment thereof;
    (c) a single chain antibody; and
    (d) a Fab fragment.

12. The antibody or fragment thereof of claim 3 wherein said antibody or fragment thereof specifically binds to said protein in a Western blot or an ELISA.

13. A hybridoma that produces the antibody or fragment thereof of claim 3.

14. A method of detecting HDPPA04 protein in a biological sample comprising:
    (a) contacting the biological sample with the antibody or fragment thereof of claim 3; and
    (b) detecting the HDPPA04 protein in the biological sample.

15. An isolated antibody or fragment thereof that specifically binds to a protein selected from the group consisting of:
    (a) a protein whose amino acid sequence consists of the full-length HDPPA04 polypeptide encoded by the HDPPA04 cDNA contained in ATCC Deposit Number PTA-867;
    (b) a protein whose amino acid sequence consists of the mature form of the HDPPA04 polypeptide encoded by the HDPPA04 cDNA contained in ATCC Deposit Number PTA-867;
    (c) a protein whose amino acid sequence consists of a portion of the HDPPA04 polypeptide encoded by the HDPPA04 cDNA contained in ATCC Deposit Number PTA-867, wherein said portion is at least 30 contiguous amino acid residues in length; and
    (d) a protein whose amino acid sequence consists of a portion of the HDPPA04 polypeptide encoded by the HDPPA04 cDNA contained in ATCC Deposit Number PTA-867, wherein said portion is at least 50 contiguous amino acid residues in length.

16. The antibody or fragment thereof of claim 15 that specifically binds protein (a).

17. The antibody or fragment thereof of claim 15 that specifically binds protein (b).

18. The antibody or fragment thereof of claim 15 that specifically binds protein (c).

19. The antibody or fragment thereof of claim 15 that specifically binds protein (d).

20. The antibody or fragment thereof of claim 18 that specifically binds protein (a).

21. The antibody or fragment thereof of claim 17 wherein said antibody or fragment thereof is human.

22. The antibody or fragment thereof of claim 17 wherein said antibody or fragment thereof is polyclonal.

23. The antibody or fragment thereof of claim 17 wherein said antibody or fragment thereof is monoclonal.

24. The antibody or fragment thereof of claim 17 which is selected from the group consisting of:
    (a) a chimeric antibody or fragment thereof;
    (b) a humanized antibody or fragment thereof;
    (c) a single chain antibody; and
    (d) a Fab fragment.

25. An isoltaed antibody or fragment thereof that specifically binds HDPPA04 protein expressed on the surface of a cell wherein said HDPPA04 protein is encoded by a polynucleotide encoding amino acids 1 to 283 of SEQ ID NO:5761.

26. The antibody or fragment thereof of claim 25 wherein said antibody or fragment thereof is monoclonal.

27. The antibody or fragment thereof of claim 25 wherein said antibody or fragment thereof is polyclonal.

28. The antibody or fragment thereof of claim 25 wherein said antibody or fragment thereof is human.

29. The antibody or fragment thereof of claim 25 which is selected from the group consisting of:
    (a) a chimeric antibody or fragment thereof;
    (b) a humanized antibody or fragment thereof;
    (c) a single chain antibody; and
    (d) a Fab fragment.

30. The antibody or fragment thereof of claim 25 wherein said antibody or fragment thereof specifically binds to said protein in a Western blot or an ELISA.

31. The antibody or fragment thereof of claim 25 wherein the amino acid sequence of said HDPPA04 protein consists of amino acid residues 20 to 283 of SEQ ID NO:5761.

* * * * *